US011491208B2

(12) United States Patent
In et al.

(10) Patent No.: US 11,491,208 B2
(45) Date of Patent: Nov. 8, 2022

(54) SEQUENCE-SPECIFIC IN VIVO CELL TARGETING

(71) Applicants: GFLAS Life Sciences, Inc., Seoul (KR); SEOUL NATIONAL UNIVERSITY R&DB FOUNDATION, Seoul (KR)

(72) Inventors: Sungyong In, Germantown, MD (US); Sunghwa Choe, Seoul (KR); Mi Jin Park, Seoul (KR); Aiden Y. Park, Seoul (KR); Jung Hak Lim, Seoul (KR); Dong Wook Kim, Seoul (KR); Youngdong Yoo, Seoul (KR); Jongjin Park, West Lafayette, IN (US)

(73) Assignees: GFLAS LIFE SCIENCES, INC., Seoul (KR); SEOUL NATIONAL UNIVERSITY R&DB FOUNDATION, Seoul (KR)

( * ) Notice: Subject to any disclaimer, the term of this patent is extended or adjusted under 35 U.S.C. 154(b) by 0 days.

(21) Appl. No.: 17/033,313

(22) Filed: Sep. 25, 2020

(65) Prior Publication Data
US 2021/0077594 A1 Mar. 18, 2021

Related U.S. Application Data

(63) Continuation of application No. PCT/IB2019/000346, filed on Mar. 27, 2019.

(60) Provisional application No. 62/724,199, filed on Aug. 29, 2018, provisional application No. 62/652,150, filed on Apr. 3, 2018.

(30) Foreign Application Priority Data

Mar. 27, 2018 (KR) .................. KR10-2018-0035298

(51) Int. Cl.
| | |
|---|---|
| *A61K 38/46* | (2006.01) |
| *A61P 35/00* | (2006.01) |
| *A61K 31/7052* | (2006.01) |
| *C12N 15/113* | (2010.01) |
| *C12N 9/22* | (2006.01) |
| *C12N 9/52* | (2006.01) |

(52) U.S. Cl.
CPC ........ *A61K 38/465* (2013.01); *A61K 31/7052* (2013.01); *A61P 35/00* (2018.01); *C12N 9/22* (2013.01); *C12N 9/52* (2013.01); *C12N 15/113* (2013.01); *C12N 2310/20* (2017.05); *C12N 2320/30* (2013.01)

(58) Field of Classification Search
CPC .......... C12N 9/22; C12N 9/52; C12N 15/113; C12N 2310/20
See application file for complete search history.

(56) References Cited

U.S. PATENT DOCUMENTS

| | | |
|---|---|---|
| 2016/0186152 A1 | 6/2016 | Brouns et al. |
| 2017/0114413 A1 | 4/2017 | Hahn et al. |
| 2017/0145405 A1 | 5/2017 | Tang et al. |
| 2017/0247690 A1 | 8/2017 | Quake et al. |
| 2017/0247960 A1 | 8/2017 | Kyle et al. |
| 2018/0237771 A1 | 8/2018 | Kim et al. |
| 2018/0355416 A1* | 12/2018 | Mischel ............... C12Q 1/6841 |
| 2021/0128697 A1 | 5/2021 | Choe et al. |

FOREIGN PATENT DOCUMENTS

| | | |
|---|---|---|
| WO | WO-2016154596 A1 | 9/2016 |
| WO | WO-2016160721 A1 | 10/2016 |
| WO | WO-2017053879 A1 | 3/2017 |
| WO | WO-2018009525 A1 | 1/2018 |
| WO | WO-2018034554 A1 | 2/2018 |
| WO | WO-2018009525 A8 | 2/2019 |
| WO | WO-2019186275 A1 | 10/2019 |
| WO | WO-2019190198 A1 | 10/2019 |

OTHER PUBLICATIONS

Sircoulomb et al (BMC Cancer 2010, 10:539, 18 pages) (Year: 2010).*
Adey et al., The haplotype-resolved genome and epigenome of the aneuploid HeLa cancer cell line. Nature. 500(7461): 207-211 (2013).
Baker et al., RAC-tagging: Recombineering and Cas9-assisted targeting for protein tagging and conditional analyses. Scientific Reports (6) :25529 ( 2016).
Chen et al., CRISPR/Cas9-based Genome Editing in Pseudomonas aeruginosa and Cytidine Deaminase-Mediated Base Editing in *Pseudomonas* Species. Cell Press 6(31): 222-231 (2018).
Clements et al., RICE CRISPR: Rapidly increased cut ends by an exonuclease Cas9 fusion in zebrafish. Genesis. 55(8): 1-6 (2017).
Dobrovolskaia, Pre-clinical immunotoxicity studies of nanotechnology-formulated drugs: challenges, considerations and strategy. J Control Release. 220(0 0): 571-583 (2015).
Harrington et al.: Programmed DNA destruction by miniature CRISPR-Cas14 enzymes. Science. 362(6416): 839-842 (2018).
Landry et al., The genomic and transcriptomic landscape of a HeLa cell line. G3 (Bethesda). 3(8):1213-1224 (2013).
Lin et al., Fusion of SpCas9 to *E. coli* Rec A protein enhances CRISPR-Cas9 mediated gene knockout in mammalian cells. J Biotechnol. 247:42-49 (2017).

(Continued)

*Primary Examiner* — Richard A Schnizer
(74) *Attorney, Agent, or Firm* — Wilson Sonsini Goodrich & Rosati

(57) ABSTRACT

Enhanced, specific nucleic acid targeting complexes comprising endo and exonuclease activity, and related methods that allow both targeted degradation of specific and/or non-specific nucleic acids in vivo and specific temporal regulation of nuclease activity to prevent off-target activity are disclosed herein. Through practice of the disclosure, nucleic acids, and cells harboring them, such as cancer cells or pathogens, are selectively degraded in vivo.

10 Claims, 32 Drawing Sheets
Specification includes a Sequence Listing.

(56) References Cited

OTHER PUBLICATIONS

Liu et al., Comprehensive mapping of the human papillomavirus (HPV) DNA integration sites in cervical carcinomas by HPV capture technology. Oncotarget. 7(5):5852-5864 (2016).

Lovett et al., Identification and purification of a single-stranded-DNA-specific exonuclease encoded by the recJ gene of *Escherichia coli*. PNAS 86(8): 2627-2631 (1989).

Makarova et al., Snapshot: Class 2 CRISPR-Cas Systems. Cell 168: 2 pages (2017).

Meissner et al., Nucleotide sequences and further characterization of human papillomavirus DNA present in the CaSki, SiHa and HeLa cervical carcinoma cell lines. J Gen Virol. 80 ( Pt 7):1725-1733 (1999).

Nattestad et al., Complex rearrangements and oncogene amplifications revealed by long-read DNA and RNA sequencing of a breast cancer cell line. Genome Res. 28(8): 1126-1135 (2018).

PCT/IB2019/000346 International Report on Patentability dated Sep. 29, 2020.

PCT/IB2019/000346 International Search Report and Written Opinion dated Aug. 30, 2019.

Radovcic et al., CRISPR-Cas adaptation in *Escherichia coli* requires RecBCD helicase but not nuclease activity, is independent of homologous recombination, and is antagonized by 5' ssDNA exonucleases. Nucleic Acids Research 46(19): 10173-10183 (2018).

Yan et al., Functionally diverse type V CRISPR-Cas systems. Science 363: 88-91 (2019).

Koo et al., Selective disruption of an oncogenic mutant allele by CRISPR/Cas9 induces efficient tumor regression. Nucleic Acids Res 45(13):7897-7908 (2017).

Lee, G+FLAS Challenges Anti-Cancer Drug Based on CRISPR PLUS Technology. (2018).

PCT/KR2019/003585 International Search Report and Written Opinion dated Jul. 5, 2019.

* cited by examiner

>chr17:26,654,125-26,654,164 (10 + 30 bp)
5' - CTRCAG GTGTGTACCA ACACGTATGG CTAATTTGTT TTGT -3'

>chr17:75,068,158-75,068,197 (30 + 10 bp)
5' - CTT CCTTCCTTCC TTCTTCTTTC GTTCCTTCCT TCCTTCT -3'

>Duplicated Region? (30 + 30 bp)
5' - CTT CCTTCCTTCC TTCTTCTTTC CTTCCTT GTACCA
ACACGTATGG CTAATTTGTT TTGT -3' * 37

SEQUENCE-SPECIFIC IN VIVO CELL TARGETING

CROSS-REFERENCE

This application is a continuation of International Patent Application No. PCT/IB2019/000346, filed Mar. 27, 2019, which claims the benefit of U.S. Provisional Application No. 62/652,150 filed Apr. 3, 2018, U.S. Provisional Application No. 62/724,199 filed Aug. 29, 2018, and Korean patent application No. KR 10-2018-0035298, filed on Mar. 27, 2018, all of which are incorporated herein by reference in their entireties for all purposes.

SEQUENCE LISTING

The instant application contains a Sequence Listing which has been submitted electronically in ASCII format and is hereby incorporated by reference in its entirety. Said ASCII copy, created on Nov. 24, 2020, is named 53470_706_301_SL.txt and is 965,031 bytes in size.

BACKGROUND

Targeting specific cells for degradation or cell death remains a challenge. Cancer or pathogen cell populations are often difficult to target without also impacting undiseased host cell populations. Consequently, particularly for weakened individuals but also for individuals suffering from or identified as having a condition in general, treatment regimens convey negative health consequences that may be harmful or that may negatively impact the efficacy of the treatment regimen.

SUMMARY OF THE INVENTION

Provided herein are embodiments related to nucleic acid targeting to improve health, ameliorate at least one symptom of a disorder, reduce a pathogen load or to target particular cells such as cancer cells for selective elimination. Methods and compositions herein relate to the selective targeting of particular nucleic acid molecules for both endonucleolytic and exonucleolytic degradation. Target nucleic acids are identified through base pairing by a guide nucleic acid molecule, such as a guide nucleic acid molecule in a CRISPR or other nucleoprotein complex. Targeted nucleic acids are cleaved so as to introduce a double-strand break. Target nucleic acid degradation is then facilitated through exonucleolytic activity, such as exonucleolytic activity associated with or fused to the protein component of the nucleoprotein complex, which causes the nucleic acid to be degraded selectively from an endonucleolytically introduced cleavage site. In addition, nonspecific exonuclease activity of CRISPR or other nucleoprotein complex is induced by crRNA-guided sequence specific endonuclease activity, which degrade cellular DNA/RNA molecules non-selectively.

Further summary is obtained in part through reference to the claims as listed below.

In various aspects, the present disclosure provides a method of selectively inducing cell death in a cell, the method comprising: a) administering to a subject in need thereof, a chimeric polypeptide comprising a first domain comprising sequence-specific endonuclease activity and a second domain comprising exonuclease activity a guide nucleic acid comprising a sequence complementary to a target nucleic acid in the cell; and b) cleaving the target nucleic acid, thereby inducing cell death.

In some aspects, the target nucleic acid is associated with a disorder. In some aspects, the target nucleic acid is in a cancer cell of the subject. In some aspects, the target nucleic acid is absent in a healthy cell of the subject. In some aspects, the target nucleic acid comprises a sequence associated with a cancer. In some aspects, the target nucleic acid comprises RNA.

In other aspects, the target nucleic acid comprises DNA. In some aspects, the target nucleic acid is within a region comprising a chromosomal abnormality. In some aspects, the chromosomal abnormality is selected from the group consisting of: a translocation, a deletion, a duplication, an inversion, an insertion, a ring, copy number variations, an indel, and an isochromosome. In some aspects, the cell is in a plurality of cells.

In further aspects, the plurality of cells comprises a healthy cell. In some aspects, after the administering, the healthy cell lives. In some aspects, after the administering, the healthy cell proliferates. In some aspects, the cleaving comprises cleaving at one or more than one cleavage site in the cell. In some aspects, the target nucleic acid is associated with a disorder. In some aspects, the cancer comprises lung cancer, pancreatic cancer, breast cancer, ovarian cancer, colon cancer, or cervical cancer.

In some aspects, the target nucleic acid comprises a single nucleotide polymorphism specific to a cancer, a translocation, or a sequence associated with cancer progression. In some aspects, the target nucleic acid comprises a portion of a gene selected from the group consisting of: BRCA-1, BRAF, BCR-ABL, HER2, KIF5A, IRX1, ADAMTS16, GNPDA2, KCNE2, SLC15A5, SMIM11, DACH2, HERC2P2, CD68SHBG, ERBB2, KRT16, LINC00536, TRPS1, CDK8, TRAPPC9, HERC2P2, SIRPB1, MRC1, ATP11A, POTEB, HERC2P2, PRDM9, CDKN2B, HPV, LINE2 (MT2), CCR5, or HPRT1.

In some aspects, the chimeric polypeptide further comprises inducible non-specific nuclease activity. In some aspects, the inducible non-specific nuclease activity is activated by site-specific cleavage of the target nucleic acid by the chimeric polypeptide. In some aspects, the first domain comprises a Cas12a (or Cpf1) domain, a Cas12a domain, a Cas12b domain, a Cas12c domain, a Cas12d domain, a Cas12e domain, a Cas12f domain, a Cas12g domain, a Cas12h domain, a Cas12i domain, a Cas13a domain, a Cas13b domain, a Cas14 domain, or a Cas9 domain. In further aspects, the first domain comprises a Cas12a (or Cpf1) domain. In other aspects, the first domain comprises a Cas13a or Cas13b domain. In still other aspects, the first domain comprises a Cas9 domain. In some aspects, the guide nucleic acid comprises a sequence selected from the group consisting of the sequences listed in Table 6 and paragraph [00303] or Table 7 and paragraph [00305].

In some aspects, the second domain comprises a RecE domain, a RecJ domain, a T5 domain, a Lambda Exonuclease domain, a RecBCD domain, a DNA pol I small fragment domain, an ExoI domain, an ExoII domain, an ExoVII domain, an Exo T domain, a Trex1 domain, or a Trex2 domain. In some aspects, the chimeric polypeptide generates a 3' OH overhang. In some aspects, the chimeric polypeptide exposes a recessed 3' OH. In some aspects, the second domain comprises an enzyme having cleaved end resection activity. In some aspects, the second domain comprises mung bean nuclease. In some aspects, the target nucleic acid is absent in the healthy cell of the subject.

INCORPORATION BY REFERENCE

All publications, patents, and patent applications mentioned in this specification are herein incorporated by reference to the same extent as if each individual publication, patent, or patent application was specifically and individually indicated to be incorporated by reference, including a Korean patent application, KR 10-2018-0035298, filed on Mar. 27, 2018, which is incorporated herein by reference in its entirety.

BRIEF DESCRIPTION OF THE DRAWINGS

Some understanding of the features and advantages of the present invention will be obtained by reference to the following detailed description that sets forth illustrative embodiments, in which the principles of the invention are utilized, and the accompanying drawings of which:

FIG. 6A shows images of the cells, which from left to right are the following treatments: electroporation pulse only without any vectors (control), electroporated with vectors that target the wild-type EGFR sequence (control), and electroporated with vectors that target the mutant sequences. FIG. 6B shows a bar graph of the number of cells after each of the above mentioned treatments.

FIG. 12A shows data of cell viability after transfection of cells with CRISPR/Cas9 constructs targeting different gene loci including pulse only, NT1, HPRT1, CCR5, and MT2 at 24 h, 42 h, and 72 h post-transfection using a cell titer glo assay.

FIG. 12B shows data of cell viability after transfection of cells with CRISPR/Cas9 constructs targeting different gene loci including pulse only, NT1, HPRT1, CCR5, and MT2 by cell counting.

FIG. 15A shows the SK-BR-3 ERBB2 region WGS data from Nattestad et al.

FIG. 15B shows the SK-BR-3 ERBB2 CNV data from Nattestad et al.

FIG. 15C shows the SK-BR-3 ERBB2 CNV junction sequence, which was inferred from Nattestad et al. Figure discloses SEQ ID NOS 3292-3298, respectively, in order of appearance.

FIG. 16A shows data from electroporation of cells with CRISPR/Cas9 constructs targeting different gene loci. Samples include pulse only, NT1, MT2, ERBB2, KRT16, and no pulse.

FIG. 16B shows the raw data associated with FIG. 16A.

FIG. 18A shows HPV and HeLa cell integration data from Adey, A. et al. The haplotype-resolved genome and epigenome of the aneuploid HeLa cancer cell line. Nature 500, 207-211 (2013).

FIG. 18B shows HPV sequence data in HeLa cell inferred from Meissner, J. D. Nucleotide sequences and further characterization of human papillomavirus DNA present in the CaSki, SiHa and HeLa cervical carcinoma cell lines. J. Gen. Virol. 80, 1725-1733 (1999), Landry, J. J. M. et al. The genomic and transcriptomic landscape of a HeLa cell line. G3:Genes|Genomes|Genetics 3, 1213-24 (2013), Adey, A. et al. The haplotype-resolved genome and epigenome of the aneuploid HeLa cancer cell line. Nature 500, 207-211 (2013), and Liu, Y., Lu, Z., Xu, R. & Ke, Y. Comprehensive mapping of the human papillomavirus (HPV) DNA integration sites in cervical carcinomas by HPV capture technology. Oncotarget 7, 5852-5864 (2016).

FIG. 18C shows an electrophoresis gel picture of PCR product which are repeat region between HPV sequence in HeLa cell, based on Meissner et al, Landry et al, Adey et al, and Liu et al.

FIG. 19A shows the live cell number after electroporation of cells with CRIPSR/Cas9 targeting CCR5, MT2, and PRDM9.

FIG. 19B shows the live cell number after electroporation of cells with CRIPSR/Cas9 targeting CCR5, MT2, PRDM9, and HPV_1.

FIG. 20A shows a graph of cell viability after electroporation of cells with CRIPSR/Cas9. Samples include pulse only (GFP), CCR5, MT2, HPV_1, and PRDM9, at 24 h, 48 h, and 72 h post-transfection.

FIG. 20B shows a graph of HeLa cell death by targeting the HPV gene using a cell titer glo assay, with samples of NT1, NT2, NT3, CCR5, MT2, and HPV_1.

DETAILED DESCRIPTION

Figure 1:
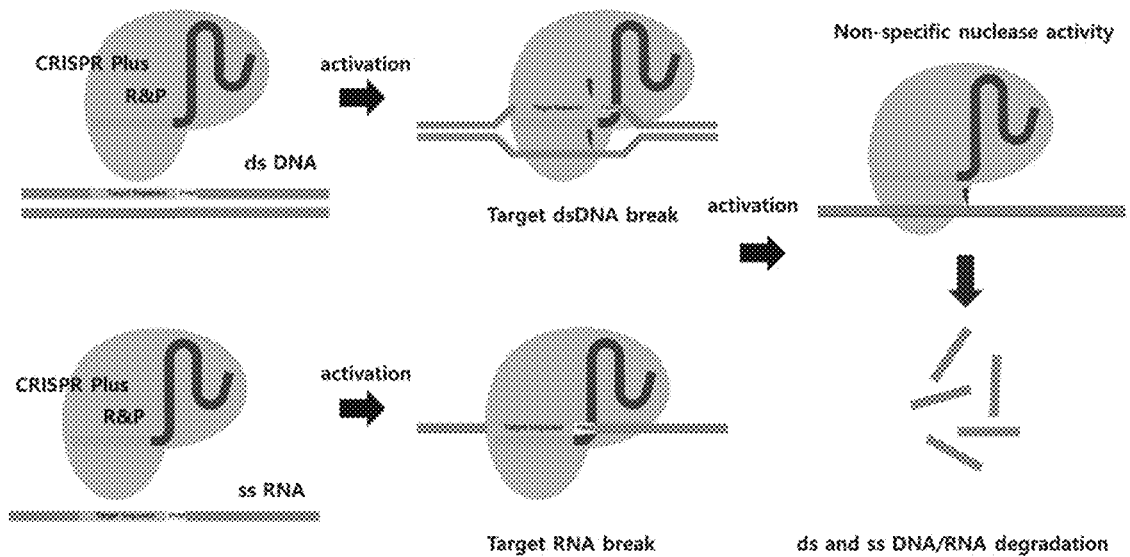
FIG. 1 shows a schematic of CRISPR/Cas complex single and double-stranded nucleic acid endonuclease and exonuclease activity.

Disclosed herein are compositions and methods related to the selective targeting of nucleic acids, such as nucleic acids in pathogen cells or in cells having dysregulated growth or proliferation often associated with cancer. Through the disclosure herein, targeted nucleic acids are selectively degraded, so as to often lead to their clearance from an individual. Cellular DNA/RNA also are degraded by non-specific exonuclease activity. Clearance is often effected through cell death such that cells harboring the nucleic acid are selectively killed. However, extracellular nucleic acids such as viral nucleic acids are also targeted through some embodiments of the disclosure herein.

Targeted clearance is accomplished through a combination of sequence-specific nucleic acid detection and an endonucleolytic/exonucleolytic degradation activity. Compositions and methods often comprise a sequence specificity component. In many embodiments herein, the moiety comprises a guide nucleic acid such as a guide RNA or guide DNA that achieves sequence specificity through base pairing to a reverse-complementary (often referred to as merely 'complementary') base sequence in a target nucleic acid. However, alternatives such as TALEN, zinc finger or other programmable, specific sequence-identifying moiety are also contemplated. In exemplary embodiments, sequence specificity is conveyed through a guide RNA that is reverse complementary to a segment of a target nucleic acid molecule.

Upon identifying a target nucleic acid, clearance is effected through combined endonuclease/exonuclease activity, such as that conveyed through a protein component of a nucleoprotein complex such as a CRISPR/Cas nucleoprotein complex. Further, non-specific exonuclease activity of the protein component of a nucleoprotein complex is also activated upon identifying a target nucleic acid. The non-specific exonuclease activity degrades non-specifically cellular DNA/RNA molecules, thereby causing cell death. Exonuclease activity herein means that enzymes work by cleaving nucleotides one at a time from the end (exo) of a polynucleotide chain. Endonucleolytic cleavage is effected through CRISPR/Cas endonucleolytic activity or through other endonucleolytic activity associated with or directed by the sequence-specifying moiety as discussed above. Such activity cleaves the target nucleic acid at, near, or in a manner directed by the sequence specifying moiety, such that nucleic acids harboring a target sequence are selectively cleaved. Endonucleolytic cleavage herein means cleavage of the phosphodiester bond within a polynucleotide chain by enzymes.

Degradation is further facilitated by a second nucleic acid degrading activity. This activity is in some cases sequence-specific or otherwise directed by the sequence specifying moiety. Alternately, the activity is targeted to double-strand breaks, independent of sequence, but such that double-strand or single-strand breaks generated by the endonucleolytic activity above will be selectively or nonselectively targeted for further degradation.

In exemplary complexes and methods herein, the second activity is an exonuclease activity and is delivered in association with the endonucleolytic activity, such as through fusion to the endonucleolytic activity in a chimeric polypeptide having a common phosphodiester backbone, such that the endonucleolytic activity is directed to the endonucleolytic cleavage site. In another implementation, co-administration or other mechanism for delivery of the second activity is also contemplated. Nucleic acids that are specifically identified, specifically cleaved endonucleolytically, and further subjected to exonuclease activity or other activity that 'proliferates' a DNA lesion directed by the sequence specificity moiety are very often damaged such that they no longer encode sufficient information to encode ongoing cellular or viral activity. That is, upon being subjected to a composition or method as disclosed herein, a nucleic acid is likely to have lost sufficient sequence such that it no longer encodes at least one protein necessary for cellular function, thereby killing the cell. Similarly, nucleic acids subjected to a composition or method as disclosed herein are likely to be identified as damaged by a host cell independent of how much of their coding capacity is lost through endo- and exonucleolytic activity, such that the cell is targeted for degradation through internal DNA integrity checkpoints leading to cell apoptotic mechanisms. That is, non-specific exonuclease activity induced by activation of crRNA-guided sequence-specific nuclease activity degrades non-specifically cellular DNA/RNA molecules, which causes a fatal effect in the cell.

Temporal regulation is achieved through temporal, specific inactivation of nuclease complexes by at least one of enzymatic inactivation and sequestration via antibody binding. Temporal inactivation conveys the benefit of clearing the nuclease from an individual, either locally or systemically, so as to reduce the risk of off-target activity, particularly in situations where targeted nucleic acids are largely or completely cleared from an individual or a particular site at an individual.

As discussed above, some compositions and methods comprise temporal regulation of activity through administration of a treatment or composition that impacts at least one of nucleic acid recognition, endonucleolytic activity and exonucleolytic activity or other activity consistent with the disclosure herein. An individual is subjected to a method or administered a composition consistent with the disclosure herein and is administered a follow-on composition or treatment so as to inactivate the nuclease-activity composition. Examples include but are not limited to local heat administration, $Zn^{2+ion}$ or its variants, for example, $ZnSO_4$, or any others shown in Table 4 or their variants, administration or other composition administration that inactivates, destabilizes or otherwise neutralizes the nuclease activity, template-killing nucleic acids that stably bind the guide nucleic acid, rendering it unable to direct further degradation, endonuclease-killing nucleic acids that stably bind the CRISPR/Cas complex, rendering it unable to processively degrade nucleic acid substrate in a target-directed manner, and antibodies that bind and impact, up to and including inactivate, a complex responsible for specific nucleic acid identification or targeted degradation. Accordingly, through practice of the disclosure, herein, one accomplishes specific targeting and degradation of particular nucleic acids, both through endonucleolytic cleavage and through proliferation of a cleavage event such that a substantial or in some cases catastrophic lesion is introduced in a nucleic acid molecule, up to and including deletion of an entire nucleic acid am or an entire nucleic acid molecule. Similarly, one accomplishes specific control of this activity both through selection of a guide RNA or other programmable sequence specifying moiety so as to direct nucleic acid degrading activity to a particular target or class of target, and in some cases through temporal termination of activity so as to clear the activity from an individual once a particular time period has passed.

Context of the disclosure. Cancer is a major human health issue. One of the most prominent properties of cancer is indefinite proliferation, which has been used to select and develop anticancer drugs that target this trait. Therapies targeting highly proliferative cells in the body are often used as a first line chemotherapy or radio therapy. These methods, however, also target normal cells that highly proliferate in the body, such as hair and immune cell populations, which may result in moderate to severe side effects and sufferings from the patients. The development of highly specific anti-cancer therapeutics that selectively target the cancer cells in the body provides the potential for substantial benefits to patients.

Recently, immuno-oncology using a patient's immune system for cancer treatment has achieved substantial progress in anti-cancer therapies. CAR-T cell therapy, for example, uses patient-derived immune T cells that express antigen receptors in the cell membrane through genetic manipulation or other approaches. The antigen receptors recognize specific membrane proteins in cancer cells and destroy them. However, the strength of interaction of biomolecules between cancer cells and anti-cancer drugs is often not satisfactory for complete specificity, often resulting in off-target effects or incomplete targeting. Thus, even though targeted cancer therapy and immuno-oncology are considered to be less toxic than traditional cancer therapy, they still have substantial side effect antigen-directed therapies often exhibit both side effects and remission followed by relapse of cancer cell growth and progression. Also, finding specific membrane proteins in cancer cells remains challenging.

Existing Approaches. Targeted cancer therapies show promise and have been actively developed. Targeted cancer therapies are anti-cancer therapeutics that block cancer growth by inhibiting specific molecular targets or pathways that are involved in the cancer pathogenesis. Targeted cancer therapies are sometimes called "molecularly targeted drugs" or "molecularly targeted therapies". Targeted therapies are currently the focus of much anticancer drug development.

Targeted approaches require targets specific to one or another cell type to be eliminated. Many approaches identify specific targets by comparing the amounts of total proteins in cancer cells with those in normal cells. Proteins that are specifically present in cancer cells or that are more abundant in cancer cells are potential targets. Stronger candidates are known to be important for the cancer pathogenesis. A well-known example of differentially expressed target protein is the human epidermal growth factor receptor 2 protein (HER-2). HER-2 is expressed at high levels on the surface of some cancer cells. Several targeted therapies have been developed against HER-2 including trastuzumab (Herceptin®), which is approved to treat certain breast and stomach cancers that overexpress HER-2.

Another approach is to detect mutant proteins that cause cancer progression. For example, the cell growth signaling protein BRCA1 or BRAF is present in an altered form in many breast cancer and melanomas, respectively. Many targeted therapeutics are developed to target these mutant forms and are approved to treat patients with inoperable or metastatic cancers that contain these altered proteins.

Abnormalities in chromosome specifically present in cancer cells are also used for potential targets. These chromosome abnormalities often create gene fusion, resulting in the expression of fusion protein that play pivotal role in cancer progression. Such abnormal fusion proteins specifically present in cancer cells can be used for the development of targeted therapies.

The imatinib mesylate (Gleevec) targets the BCR-ABL fusion protein that has been known to be formed by fusion of two genes and exist in some leukemia cells and drives the leukemia progression.

Most targeted therapies use either small molecules or monoclonal antibodies to block or neutralize specific proteins or pathways present specifically in cancer cells. Small molecule candidates are usually identified through high-throughput screens, in which the effects of test compounds on a specific target protein are massively screened. For the production of monoclonal antibodies, specific target proteins that are specifically present in cancer cells are used to inject animals (usually mice) to induce the animals to make antibodies against the target. These antibodies are then tested to find those that bind best to the target without binding to non-target proteins.

Spatiotemporally specific nucleic acid based approaches. Cancer cells often exhibit increased mutation rates relative to healthy cells. These increased mutation rates may manifest themselves in at least one of chromosomal variations, such as insertions, deletions, duplications, transversions or translocations, or in local mutations such as single- or few-base insertions, deletions, or single nucleotide polymorphisms (SNPs). These mutations are not always causative or even specifically indicative of actively dividing or metastatic cells within a tumor cell population. However, they often identify cells as including genetic mutation on specific genomic sites that do not exist in normal cells, depending on the originated tissues and the type of cancer. Those cancer-specific mutation such as SNPs are used to cancer cell specific markers in approaches disclosed herein.

CRISPR/Cas proteins are nucleic acid-guided enzymes (e.g., RNA guided) that recognize specific sequence of the DNA or RNA, and cleave them as a component of bacterial adaptive immune system. These specific DNA/RNA cleavage systems have been considered as attractive sequence-specific genome editing tools in vivo. For example, CRISPR/Cas9-based genome editing (GE) tools show promise in the field of disease therapeutics and agricultural traits. Genome editing of CRISPR/Cas-gRNA complex is achieved by site-specific dsDNA/RNA cleavage by RNA-guided endonuclease proteins such as Cas12a (or Cpf1), a Cas12a, a Cas12b, a Cas12c, a Cas12d, a Cas12e, a Cas12f, a Cas12g, a Cas12h, a Cas12i, a Cas13a, a Cas13b, a Cas14, or a Cas9, or others, followed by sequent cellular repair mechanism. A number of different programmable endonucleases, such as Cas endonucleases, that cleave nucleic acids are consistent with the present disclosure. Nucleic acid cleaving programmable Cas endonucleases are described, for example, in Harrington et al. (Science. 2018 Nov. 16; 362(6416):839-842. doi: 10.1126/science.aav4294. Epub 2018 Oct. 18.), which whole reference is hereby incorporated in its entirety. Nucleic acid cleaving programmable Cas endonucleases are described, for example, in Yan et al. (Science. 2019 Jan. 4; 363(6422):88-91. doi: 10.1126/science.aav7271. Epub 2018 Dec. 6.), which whole reference is hereby incorporated in its entirety. Other references, known to those of skill in the art, provide a broad range of Cas proteins, all of which are consistent with the present disclosure, including any of Cas12a (or Cpf1), a Cas12a, a Cas12b, a Cas12c, a Cas12d, a Cas12e, a Cas12f, a Cas12g, a Cas12h, a Cas12i, a Cas13a, a Cas13b, a Cas14, or a Cas9. Proteins that bind to and are guided by a guide RNA to direct sequence specific cleavage or that, otherwise, bind nucleic acid sequences in a sequence specific way to trigger non-specific cleavage are consistent with the present disclosure. Guide RNA that has a complementary sequence to the target DNA/RNA confer the sequence specificity of CRISPR/Cas-gRNA complex-dependent target site cleavage.

The genome editing function of members of CRISPR/Cas proteins, CRISPR/Cas12 and CRISPR/Cas13a is activated by gRNA-guided DNA/RNA binding, which subsequently activates non-specific nuclease activity that degrade single strand DNA or RNA molecules (FIG. 1). Site specific dsDNA/RNA cleavage and non-specific single strand DNA/RNA cleavage of CRISPR/Cas12 and CRISPR/Cas13a are separate activities.

Enhancement of this exonuclease activity, such as through co-administration or chimeric fusion of exonuclease activity targeting both double stranded and single stranded DNA and RNA that is activated by gRNA-guided target site binding to a CRISPR complex increases nucleic acid damage and can induce cell death by destroying essential cellular DNA and RNA molecules nonspecifically and irreversibly.

Accordingly, sequence specific complexes such as CRISPR/Cas12 and CRISPR/Cas13a or other complexes referred to herein that specifically target cells such as cancer cells using selectively activated non-specific nuclease function by gRNA-guided binding to specific target sites present in cancer cells or other target cells allow one to specifically remove undesired or detrimental nucleic acids or cells that harbor them, while reducing or eliminating the negative impact on healthy proliferating cells.

The genome editing function of nucleic acid sequence directed CRISPR/Cas endonucleases such as CRISPR/Cas12 and CRISPR/Cas13a is activated by gRNA-guided DNA/RNA binding to specific target site, which subsequently activate inherent non-specific nuclease activity of the CRISPR/Cas proteins that degrade single strand DNA or RNA molecules. CRISPR/Cas proteins that have enhanced genome editing efficiency through chimeric fusion of additive nuclease functions have strong non-specific double strand (ds)/single strand (ss) DNA and RNA nuclease function activated by gRNA-guided target binding of CRISPR/Cas proteins. These systems facilitate nucleic acid targeting and degradation, such as in cancer cells, through specific cleavage of molecules having a target sequence, followed by nonspecific single or double stranded exonuclease activity. After the completion of the effect, one may administer a specific inhibitor and selective antibody against CRISPR/Cas proteins to remove the function of the complex remaining in the body to abolish the unwanted side effect of the proteins.

Figure 2:
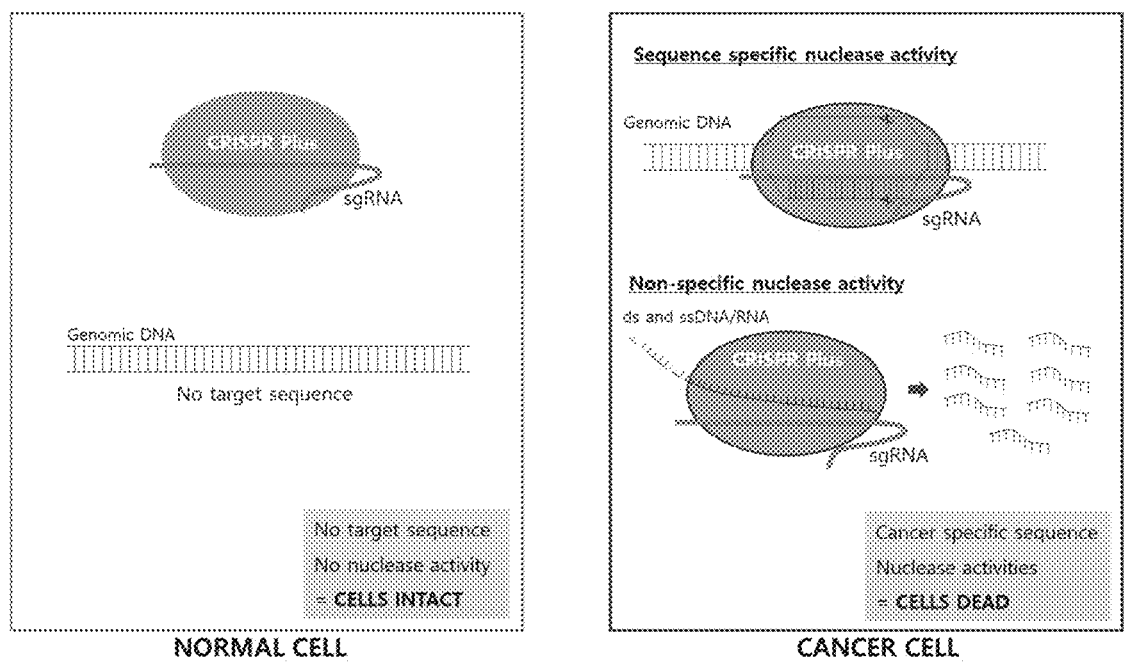
FIG. 2 shows a schematic of CRISPER/Cas activity on target and nontarget nucleic acid substrates.

In an aspect of the present disclosure, cancer cell specific mutations such as SNPs are recognized by gRNA of CRISPR nuclease complexes which contain complementary sequence to the specific mutations such as SNPs. Sequence specific binding between mutations such as SNPs on genome of cancer cells and gRNA activate the genome editing function of CRISPR nuclease proteins resulting the target DNA/RNA breakage. This activation subsequently activates the inherent non-specific exonuclease function of CRISPR nuclease and/or CRISPR PLUS' that destroys cellular ds and ss DNA/RNA molecules irreversibly in cancer cell, resulting in cell death (FIG. 2).

After completion of therapeutic effect CRISPR nuclease complexes, the CRISPR/Cas terminator, such as $ZnSO_4$ or others as indicated herein, and/or a specific antibody against CRISPR nuclease and/or CRISPR PLUS™ are administrated to terminate unwanted CRISPR activity remained in the body to minimize side effects or otherwise clear the complexes.

Accordingly, in an aspect of the present disclosure, one achieves unprecedented cancer cell-specific targeting in the body through specific activation of CRISPR/Cas nuclease function, as well as termination of the unwanted activity of the protein complex in vivo through specific inhibitor and selective antibody.

Advantages of the approaches disclosed herein. Practice of the disclosure herein has numerous advantages both in the context of cancer therapy and elsewhere. By way of example, the binding between nucleotides molecules (DNA:DNA or DNA:RNA) that have complementary sequence is relatively strong and highly specific as compared with interaction between other biomolecules such as ligand:receptor and antigen:antibody. The cancer cell specific therapeutic effect of the present disclosure herein, as one example implementation of the present disclosure, is based on high specificity of complementary DNA:RNA binding, and thus can be customized for the needs of individual patients or cell types. The nuclease activity of CRISPR PLUS™-gRNA complex may depend on the existence of specific mutations such as SNPs in the genome of the cell that is complementary to the gRNA sequence in the cell. Thus, the cell specific therapeutic effect of the present disclosure herein is greater than that of many other anti-cancer therapies currently developed and used.

By way of example, the cell targeting is specific and readily individualized. Cancers often have their own specific markers depending on the origin and cause of carcinogenesis. Different patients may have different types of cancer. Thus, the same therapy may exhibit different efficacy in different patients. In the therapeutic approaches disclosed herein, the cancer of each patient may be optionally preliminarily analyzed to identify specific SNPs which are used to identify specific markers of cancer or of particular cancer cells in each patient. Thus, each CRISPR PLUS"-gRNA complex or other complex used for this therapy may be crafted to be specific to the particular cancer genome in question. Therefore, variation among treatment efficacies caused by underlying variation across cancer cells between patients may be greatly reduced, as it is an individual's particular cancer cell line that can be targeted.

Further, target selection is not limited by prior cancer knowledge or by cancer mechanism. Through the practice of the present disclosure herein, any number of sequence targets may be identified. There need not be a mechanistic link between a particular mutation such as an SNP and cancer or other disease progression. Rather, any mutation such as an SNP identified as correlating with some or all of the cells in a tumor population may be targeted. As cancer cell populations are often characterized by decreased nucleic acid reproductive fidelity, this feature of the present disclosure vastly increases the opportunities for targeting cells for degradation.

Additionally, active complexes are readily cleared. This allows the sequence specificity of the disclosure to be complemented by temporal specificity, such that the treatment regimen is readily stopped or inhibited after a selected time period. This allows one to further reduce off-target effects that may occur through persistence of the composition in non-target cells in an individual.

Target range. Much of the present disclosure herein relates to cancer cell targeting as an exemplary application or implementation of the present technology. However, one readily understands that the scope and applicability of the present disclosure expands beyond tumors or particular cancer cells and encompasses additional cells or nucleic acids for which their clearance may lead to a therapeutic effect or to amelioration of at least one symptom of a condition.

Communicable diseases, for example, present many of the challenges addressed by the present disclosure herein and are similarly amenable to symptom amelioration up to and including full treatment. Many disease pathogens, for example, present variable or difficult to detect cell surface proteins, or reside within host cells so as to complicate their identification by an antibody-based approach. Similarly, small molecule treatments for many diseases involve substantial side effects, often impacting patient compliance or complicating palliative, prophylactic or preventative treatment regimens.

Pathogens causative of diseases such as malaria, sleeping sickness, or tuberculosis, for example are difficult to treat. Cells either do not present surfaces for antibody based or host-directed treatment, or rapidly change their cell surfaces so as to evade immune responses. Alternately, tuberculosis cells reproduce slowly enough that therapeutics targeting particular steps in cellular proliferation must be administered for a period so long as to jeopardize treatment compliance.

Through the practice of the present disclosure herein, cell-specific target nucleic acid sequences may be readily identified in a cellular or viral pathogen genome. Using these sequences, one readily may obtain specific targets that facilitate the sequence specific degradation of pathogen nucleic acids in a manner consistent with the present disclosure above, recited in the context of cancer but, as is apparent from the present disclosure, readily applicable to a number of disorders.

Accordingly, the present disclosure herein is consistent with targeting particular cancer cells, for example, lung cancer or pancreatic cancer, but also with targeting a broad range of eukaryotic, eubacterial or viral pathogens, such as *Plasmodium* cells, *Trypanosoma* cells, *Toxoplasma* cells, opportunistic yeast or other cells, Giardia cells, *staphylococcus* infections, *E. coli*, or viral pathogens such as HIV, influenza, HPV, or any number of other transmissible or genetic diseases.

The present disclosure provides compositions of guide RNA and Cas9 systems that can be used in a method of inducing cell death by cleaving at one or more positions in a cell. In particular embodiments, the cell is a diseased cell, such as a cancer cell, and is in a larger plurality of cells containing healthy cells and diseased (or cancer) cells. The compositions disclosed herein can be administered to the larger plurality of cells to induce cell death in only the cancer cells by targeting the guide RNA to mutant sequences present only in the cancer cells. Moreover, the guide RNA and Cas9 compositions disclosed herein target multiple sites for cutting, inducing multi-cleavage of target nucleic acids and efficient cell death.

Similarly, the present disclosure herein is consistent with ameliorating symptoms of a broad range of contagious disorders such as malaria, toxoplasmosis, sleeping sickness, Chagas disease, tuberculosis, *E. coli* infections, strep throat, influenza, the common cold, AIDS, and any number of other disorders having a nucleic acid as an integral part of a causative agent of the disorder.

Further, in an aspect of the present disclosure, unknown disorders or pathogens may be similarly addressed, so long as one or more target nucleic acid sequences are available. Thus, for example, an individual suffering from an unknown ailment and identified as having a detectable amount of an unknown organism identified only by, for example, whole sample untargeted sequencing, may nonetheless be targeted for elimination through design of a guide sequence nucleic acid complex or other sequence specific nuclease moiety so as to specifically target nucleic acids having a target sequence selected from the unknown organism's genome. The subject may be monitored for amelioration of symptoms up to and including full treatment in response to administration of a complex or practice of a method disclosed herein, so as to address the disorder without first definitively identifying the pathogen.

Having provided present disclosure relevant to the compositions and methods overall, also provided are details and variants relevant to particular aspects of the compositions and methods disclosed herein. It is understood that particular details below are generally applicable and combinable among one another to gain a broader understanding of the full scope of the various embodiments of the present disclosure herein, and that the present disclosure is sufficiently flexible to allow variations and alternative combinations without falling outside of the scope of the present disclosure herein.

Sequence specificity. As discussed above, in an aspect, embodiments of the present disclosure benefit from a sequence-specifying moiety so as to direct the nuclease activity of the present disclosure to particular targets to the exclusion of others. In exemplary embodiments, sequence specificity is conveyed through a guide nucleic acid such as a guide RNA or guide DNA. Such a molecule may be assembled into a CRISPR/Cas or other suitable complex to convey sequence specificity through base pairing to a reverse-complementary base sequence in a target nucleic acid.

However, as discussed above, a number of alternative moieties may be consistent with the present disclosure herein. Particular alternatives may include sequence-specific or sequence-recognizing proteins such as TALEN repeats, zinc finger proteins, transcription factor moieties such as helix-loop-helix or other protein structure. A beneficial feature of such moieties is that they exhibit sequence specificity in their substrate binding, such that they may direct nuclease activity complexes to particular target nucleic acid segments, and in some cases discerning among alternatives having substantial identity, in some instances differing by a single base or perhaps only a single epigenetic modification such as a base methylation. Preferably, but not exclusively these moieties are programmable, such that a target sequence can be identified and a specificity moiety subsequently selected having a nucleic acid or protein sequence that is selected to correspond to the target nucleic acid segment. Alternatively, a collection of nucleic acid binding moieties may be selected such that, rather than programming a particular structure to convey nucleic acid specificity, one may select from among a diversity of nucleic acid binding moieties, such as transcription factor nucleic acid moieties, so as to come to a moiety having nucleic acid specificity sufficient to discern between target and healthy nucleic acid segments. In particular, when a target sequence differs substantially from host or patient DNA such that the variation is greater than one or a few bases, there is substantial flexibility in specificity moiety selection. For example, in the cases when the complex is intended to target a pathogen genome or a reverse-transcribed viral genome or inserted viral genome rather than a cancer mutant cell type, specificity moieties are readily obtained from the target organism's own transcription factor collection. Accordingly, some embodiments herein may comprise endonuclease and exonuclease activities as disclosed elsewhere herein in combination with a nucleic acid specificity moiety comprising a polypeptide specificity factors rather than a guide nucleic acid.

In an aspect of the present disclosure, target nucleic acid size may vary according to the amount of information needed to convey specificity and the system through which nuclease activity is conveyed. In the case of CRISPR or CRISPR PLUS™ systems, presented as lead exemplary embodiments herein, a target nucleic acid size, and therefore minimum guide RNA or DNA size, is constrained both by the size needed to convey specificity and the size necessary for assembly into nucleoprotein complexes and to result in stable annealing. Target regions must be long enough to convey stable annealing but not so long as to lead to annealing to single-base mis-paired segments. By way of example, exemplary guide nucleic acids may have a specificity-determining region that is often 8, 9, 10, 11, 12, 13, 14, 15, 16, 17, 18, 19, 20, 21, 22, 23, 24, 25, 26, 27, 28, 29, 30, or greater than 30 nucleotides. Target regions for protein-directed sequence specificity moieties may exhibit more variation.

A number of target sequence types are consistent with the present disclosure herein, ranging from single nucleotide polymorphisms to junctions indicative of chromosomal rearrangement events to sequence targets comprising completely non-native nucleic acid sequence. By way of example, in an aspect of the present disclosure, sequence types identified by a sequence specificity moiety such as a guide RNA may include single base substitutions, single base deletions or insertions, multibase substitutions, insertions or deletions, often flanked by sequence segments that do not differ between target and non-target nucleic acids (such as wild-type or healthy sequence flanking a single base mutation in a cancer cell line). Alternately, some target sequences are selected to span a junction indicative of a chromosomal event such as a large deletion, duplication indicative of insertion of one sequence segment into another or adjacent to another on a chromosome, an inversion event, a translocation or other chromosomal rearrangement. Often, sequence on either side of the event may correspond to sequence in a healthy cell, but the positioning of the segments relative to one another may be indicative of a mutation such as a mutation relevant to a cancer or other health condition.

In an aspect of the present disclosure, by way of example, target sequences may be selected as correlating to disease. In the case of cancer treatments, target sequences may be selected as occurring in all or a substantial part of a tumor population. For example, target sequences may be selected to target actively proliferating or otherwise dangerous cells in a tumor population, or to target a tumor population as a whole or to target cells both within and outside of a particular tumor population. Target sequences may be in some cases mechanistically implicated in the disease (such as mutations implicated in misregulation of cell cycle checkpoints, for example, or mutations in known oncogenes such as p53, RB, E2F, CDK or Cyclin family members, or growth regulators such as members of the mTOR or PI3K signaling pathways). However, in an aspect of the present disclosure herein, one is not limited to targets mechanistically implicated in a disorder; rather, any sequence segment identified as correlating with or occurring specifically, predominantly, or substantially in a target cell population may be used as a target sequence. Given that many cancer or tumor cell populations exhibit defects in nucleic acid replication and subsequently accumulate mutations, the present disclosure allows a broad range of targets to be selected from. Consequently, in an aspect of the present disclosure, selection of target sequences may be greatly facilitated, as it is not limited by sequences corresponding to genes implicated in a particular disease.

By way of example, target sequences may be in some cases selected from previously determined sequences implicated in cancer or other disease. Published pathogen genomes, for example, are ready sources of target sequence, and may be selected without further verification or after verification confirming that they are not also present in the host genome. Similarly, published cancer genome information may often be relied upon for target sequence candidates.

An example of published information relevant to target sequence selection is provided in Table 1, below.

TABLE 1

| Gene | Cancer | Normal cell | SEQ ID NO: | Cancer cell | SEQ ID NO: | Mutation |
|---|---|---|---|---|---|---|
| BRCA1 Exon 7 | Breast | 608: CAAAGTATGGGCTACAGAAACCGTGC CAAAAG | 1 | 608: CAAAGTATGG GCTTCAGAAA CCGTGCCAAA AG | 11 | p.Tyr130 Phe |
| BRCA1 Exon10 | | 1615: TGGGAAAACCTAT CGGAAGAAGGCA AGCCTCC | 2 | 1615: TGGGAAAACC TATCGGTAGA AGGCAAGCCT CC | 12 | p.Lys467 non-sense |
| BRCA1 Exon11 | | 3845: GGGGCCAAGAAA - TTAGAGTCCTCAG AAGAG | 3 | 3845: GGGGCCAAG AAAATTAGAG TCCTCAGAAG AG | 13 | p.Leu120 9Ile |
| BRCA1 Exon 11 | | 4260: ATGATGAAGAAA GAGGAACGGGCTT GGAAGA | 4 | 4260: ATGATGAAGA AAG -- GAACGGGCTT GGAAGA | 14 | P.Gly 1348Asn |
| BRCA1 Exon 11 | | 3657: CATCTCAGGTTTG TTCTGAGACACCT GATGACC | 5 | 3657: CATCTCAGGT TTGTTCT- AGACACCTGA TGACC | 15 | p.Glu114 8Arg |
| BRCA2 Exon 15 | | 7466: ATATACAGGATAT GCGAATTAAGAAG AAACAAA | 6 | 7466: ATATACAGGA TATGTGAATT AAGAAGAAAC AAA | 16 | p.Arg249 4Thr |
| TP53 | Gastric | 125: TAGGAGGCCGAG CTCTGTTGCTTCG AACTCCA | 7 | 125: TAGGAGGCCG AGCTCT- TTGCTTCGAAC TCCA | 17 | p.Leu20Cys |
| MSH2 | Colon | 126: TGAGGAGGTTTCG ACATGGCGGTGCA GCCGA | 8 | 126: TGAGGAGGTT TCGACCTGGC GGTGCAGCCG A | 18 | p.Met1Leu |
| EGFR | Lung | 2137: AAAAAGATCAAA GTGCTGGGCTCCG GTGCGTT | 9 | 2137: AAAAAGATCA AAGTGCTGAG CTCCGGTGCG TT | 19 | p.Gly719 →Ser |
| FGFR3 | Liver | 1771: ATCCTCTCTCTGA AATCACTGAGCAG GAGAAAG | 10 | 1771: ATCCTCTCTC TGAAATCACT GCGCAGGAGA AAG | 20 | p.Glu545 →Ala |

A more comprehensive but still partial list of mutations associated with cancer of various types is found at the website accessible from the https link at www.mycancergenome.org/.

Alternately or in combination, in an aspect of the present disclosure, target sequences are determined de novo through tumor cell or infected sample sequencing. Samples are obtained and subjected to one or more of any number of targeted or untargeted sequencing approaches. Alleles or mutant loci are identified and selected for further analysis on the basis of their absence from a predicted healthy or host genome sequence. In some cases, the mutations or alleles are confirmed to be present exclusively in the tumor or in a subset of the tumor, such as a cell population implicated in tumor growth or metastasis.

The target sequence selection approaches are not mutually exclusive. For example, in some cases a treatment regimen comprises administration of a moiety having a guide RNA that targets a known tumor mutation. Upon observation that at least some symptoms are not ameliorated or that tumor morphology does not exhibit substantial change, or upon observation of any other sub-optimal outcome, one may proceed to sequence the remaining tumor tissue so as to identify at least one target sequence sufficient for a follow-on administration of a nuclease complex having a guide RNA or other sequence identification moiety that directs degradation of nucleic acids having the target sequence segment identified through the follow-on tumor sequencing.

The present disclosure provides a guide nucleic acid for use in a CRISPR/Cas or CRISPR PLUS™ system. A guide nucleic acid (e.g., guide RNA) can bind to a Cas protein and target the Cas protein to a specific location within a target polynucleotide. A guide nucleic acid can comprise a nucleic acid-targeting segment and a Cas protein binding segment.

A guide nucleic acid can be designed to target a pathway associated with or implicated in cancer. Non-limiting examples of pathways that can be targeted with a composition of the disclosure include apoptosis, β-catenin/Wnt signaling, cell cycle control, cellular architecture and microenvironment, chromatin remodeling/DNA methylation, cytotoxic chemotherapy mechanisms of action, DNA damage/repair, G-protein signaling, Hedgehog signaling, hormone signaling, immune checkpoints, JAK/STAT signaling, kinase fusions, MAP kinase signaling, metabolic signaling, PI3K/AKT1/MTOR, protein degradation/ubiquitination, receptor tyrosine kinase/growth factor signaling, RNA splicing, and TGFβ signaling.

A guide nucleic acid can be designed to target a pathway associated with or implicated in cancer. Non-limiting examples of genes that can be targeted with a composition of the disclosure include AKT1, ALK, BRAF, EGFR, HER2, KRAS, MEK1, MET, NRAS, PIK3CA, RET, and ROS1.

Specific targeting strategies of the present disclosure include targeting copy number variations (CNVs), which may be present in more abundance in cancer cells, targeting a structural vairation (SV) junction such as CNVs, inversions, or translocations, wherein the junction sequence can span an SV locus and another normal locus, targeting indels (insertions/deletions) such as insertions, deletions, or single nucleotide polymorphisms (SNPs), or targeting integrated sequences such as viral DNA sequences integrated into a cell. Most cells have CNVs that can be targeted. Examples of cell lines with SV include the ERBB2 gene region in SK-BR-3 breast cancer cells. Examples of cell lines having indels include the EGFR gene in HCC827 and KRT16 gene in SK-BR-3. Examples of integrated sequences include cancer cells developed by integrative tumorigenic virus such as HPV (e.g., HPV sequence in HeLa cells) or HBV.

Identifying cancer sequences to target included downloading SVs, CNVs, Indels, and SNP data of cancer cell lines from CCLE and Harmonizome web databases. The expected copy number (N) of CNV can be calculated from copy number value (V) as follows; N=⌊2×2⌋^V. Sequence data was downloaded and confirmed with human reference genome (GRCh38, hg19) from UCSC genome browser, NCBI Genbank and RefSeq database. If 5'-NGG-3's, which is a PAM (protospacer adjacent motif) sequence of *Streptococcus pyogenes* Cas9 (SpCas9), are around cancer specific sequences, some of these 20 nucleotide sequences at 3' direction of PAM were chosen and designated as CRISPR/Cas9 target spacer. Methods to select and design target sequences can meet the following three criteria: (1) G or C can be at both termini of sequences for high binding affinity of sgRNA, (2) GC contents (%) of sequences can be between 40~60% for high binding affinity of sgRNA, and (3) A or T can be between 3 and 4 nucleotide of 3' directed position of PAM, which is a cleavage site of SpCas9, for high cleavage efficiency of SpCas9.

A guide nucleic acid can be designed to target any of the following target sequences associated with specific genes in particular cell lines. TABLE 2 shows spacer sequence data table for Cas9 sgRNA. Copy number from CCLE database (https://portals.broadinstitute.org/ccle/data) & Harmonizome (http://amp.pharm.mssm.edu/Harmonizome). Indel from CCLE database. Target sequence & Locus from UCSC genome browser (https://genome.ucsc.edu/cgi-bin/hgGateway?redirect=manual&source=genome.ucsc.edu) & NCBI GenBank, RefSeq (https://www.ncbi.nlm.nih.gov/genbank, https://www.ncbi.nlm.nih.gov/refseq). * Indel mutation data were not secured in case of HeLa cancer cell line.

TABLE 2

Spacer sequence data table for Cas9 sgRNA.

| Type | Cell line | Gene name | Copy # | Indel | Essentiality | Target # | Target Sequence | SEQ ID NO: | Exon\|Intron | Locus(hg19, NGG) |
|---|---|---|---|---|---|---|---|---|---|---|
| Lung | HCC827 | EGFR | >16 | 15 bp DEL | Oncogene | 1 | CGGAGATGTCTTGATAGCGA | 21 | Exon | chr7:55,242,454(-) |
| | | VSTM2A | >13 | WT | Non-essential | 1 | AGCTTCCTAGCAAGTAACAG | 22 | Intron | chr7:54,610,610(+) |
| | | KIF5A | >14 | WT | Non-essential | 1 | GCGCATCTTCCCTTTGTTAT | 23 | Intron | chr12:57,944,543(+) |
| | HI563 | IRX1 | >8 | WT | Non-essential | 1 | GTCCGGAAGAGGAACTAGAA | 24 | Intron | chr5:3,596,613(+) |
| | | ADAMTS16 | >7 | WT | Non-essential | 1 | CTCCGTGCCGCTGGTTTATT | 25 | Intron | chr5:5,140,952(+) |
| | HI299 | GNPDA2 | >12 | WT | Oncogene | 1 | CAGAAGCTCTGCATTCATCC | 26 | Intron | chr4:44,720,076(-) |
| | | KCNE2 | >40 | WT | Non-essential | 1 | GGTGATGTGAGTTCTAGTCC | 27 | Intron | chr21:35,737,394(+) |
| | | SLC15A5 | >12 | WT | Oncogene | 1 | GGACCGATTGTGAGAAATGC | 28 | Intron | chr12:16,429,653(-) |

TABLE 2-continued

Spacer sequence data table for Cas9 sgRNA.

| Type | Cell line | Gene name | Copy # | Indel | Essentiality | Target # | Target Sequence | SEQ ID NO: | Exon\|Intron | Locus(hg19, NGG) |
|---|---|---|---|---|---|---|---|---|---|---|
| | | SMIM11 | >40 | WT | Non-essential | 1 | GTGCCCAGTGTGATGATATT | 29 | Intron | chr21:35,752,339(+) |
| | A549 | DACH2 | >18 | WT | Non-essential | 1 | GCATGGCTTTTGGCTGTTCG | 30 | Intron | chrX:85,404,410(+) |
| | | HERC2P2 | >8 | WT | Oncogene | 1 | GCTGTGATTTCAACAGGACG | 31 | Intron | chr15:23,286,778(-) |
| | | CD68 | >10 | WT | Oncogene | 1 | AGACCATTGGAGACTACACG | 32 | Intron | chr17:7,483,562(+) |
| | | SHBG | >9 | WT | Non-essential | 1 | ATAGTACTAGGCTGCCTCAC | 33 | Intron | chr17:7,534,459(+) |
| Breast | SKBR3 | ERBB2 | >33 | WT | Oncogene | 8 | CATGCTCCGCCACCTCTACC | 34 | Exon | chr17:37,863,321(+) |
| | | | | | | | CTGCAGCTTCGAAGCCTCAC | 35 | Exon | chr17:37,864,786(+) |
| | | | | | | | CTTGTTGTGGTTTCTCAACC | 36 | Intron | chr17:37,863,519(+) |
| | | | | | | | GGAAGACGCCCTCAGAAGAT | 37 | Intron | chr17:37,864,935(+) |
| | | | | | | | GCCTGTAATCCCAGCTACTC | 38 | Intron | chr17:37,846,501(+) |
| | | | | | | | CAGGCTAGAGTGAAATGGTG | 39 | Intron | chr17:37,880,586(+) |
| | | | | SCNA | | | CTTCCTTGTACCAACACGTA | 40 | junction | N/A |
| | | | | | | | CAGGTGTGTACCAACACGTA | 41 | junction | N/A |
| | | KRT16 | >8 | 2 bp DEL, 1 bp DEL 3 bp INS | Non-essential | 2 | CCAGGAGTACCAGCTGCCAT | 42 | Exon | chr17:39,766,652(-) |
| | | | | | | | TCTTCACATCATGCAGCAGC | 43 | Exon | chr17:39,766,661(+) |
| Colon | HT29 | LINC00536 | >9 | WT | Non-essential | 1 | AGTGGCCAGGATTGATTCAG | 44 | Intron | chr8:117,336,549(+) |
| | | TRPS1 | >8 | WT | Non-essential | 1 | GACAGCAGAATGACCTTGGT | 45 | Intron | chr8:116,630,763(-) |
| | | CDK8 | >18 | WT | Oncogene | 1 | CCTGTCTTGTTCCCAGTCAT | 46 | Intron | chr13:26,960,973(+) |
| | | TRAPPC9 | >13 | WT | Non-essential | 1 | GTAAGCTTACCTAGAGACCC | 47 | Intron | chr8:141,460,868(-) |
| | | HERC2P2 | >8 | WT | Oncogene | 1 | GCTGTGATTTCAACAGGACG | 31 | Intron | chr15:23,286,778(-) |
| Pancreas | Capan2 | SIRPB1 | >24 | WT | Non-essential | 1 | GACACCCTAACAGGGTTATG | 48 | Intron | chr20:1,600,151(-) |
| | | MRC1 | >18 | WT | Non-essential | 1 | CTCACTGCAGCCTTGACATC | 49 | Intron | chr10:17,853,651(+) |
| | | ATP11A | >8 | WT | Oncogene | 1 | CGTCCAAGTGTGTGAGTGAG | 50 | Intron | chr13:113,485,903(+) |

TABLE 2-continued

Spacer sequence data table for Cas9 sgRNA.

| Type | Cell line | Gene name | Copy # | Indel | Essentiality | Target # | Target Sequence | SEQ ID NO: | Exon\|Intron | Locus(hg19, NGG) |
|---|---|---|---|---|---|---|---|---|---|---|
| | | POTEB | >7 | WT | Non-essential | 1 | GTGGAAACCTCAGAGATGTC | 51 | Intron | chr15:22,082,219(-) |
| | | HERC2P2 | >7 | WT | Oncogene | 1 | GCTGTGATTTCAACAGGACG | 31 | Intron | chr15:23,286,778(-) |
| Cervix | HeLa | PRDM9 | >8 | | Non-essential | 1 | GGACCCTATCTGAATGTGCA | 52 | Intron | chr5:23,509,294(+) |
| | | CDKN2B | >10 | | Non-essential | 1 | GTGCATTCCACGCGTAAAAC | 53 | Intron | chr15:22,008,651(-) |
| | | HPV | 30 | Viral | Viral | 4 | TGCTTATTGCCACCACCTGC | 54 | viral | N/A |
| | | | | | | | CCTGCAGGAACCCTAAAATA | 55 | viral | N/A |
| | | | | | | | CCATATTTTAGGGTTCCTGC | 56 | viral | N/A |
| | | | | | | | TGCAGGTGGTGGCAATAAGC | 57 | viral | N/A |
| ETC | | LINE2 (mt2) | >100 | WT | Non-essential | 1 | AATCTCCCCCACCCTTAAGA | 58 | LINEs | N/A |
| | | CCR5 | 2 | WT | Non-essential | 1 | TGACATCAATTATTATACAT | 59 | Exon | Chr3:46,414,443(+) |
| | | HPRT1 | 2 | WT | House-Keeping | 1 | GCATTTCTCAGTCCTAAACA | 60 | Intron | chrX:133,607,781(+) |
| | | NT | 0 | N/A | N/A | 3 | GGGTAACCGTGCGGTCGTAC | 61 | NT1 | N/A |
| | | | | | | | GGGTAACCGTGGGTA | 62 | NT2 NT3 | N/A N/A |

Guide RNA can target sequences that appear multiple times in a particular gene, thereby resulting in multiple cuts upon administration of the guide RNA with Cas9. In other words, Cas9/guide RNA compositions disclosed herein induce cleavage of target sequences at multiple positions in a gene and induce cell death. For example, guide RNA can be used to target CCR5 (having two cut sites in certain cells), HPRT1 (having two cut sites in certain cells), MT2 (having over 100 cut sites in particular cells), SMIM11 (having over 40 cut sites in certain cells), GNPDA2 (having over 12 cut sites in particular cells), SLC15A5 (having over 12 cut sites in particular cells), and KCNE2 (having over 40 cut sites in particular cells). In some embodiments, controls include HPRT1 (a house keeping gene). CCR5, HPRT1, MT2, SMIM11, and KCNE2 can be non-essential genes. In particular embodiments, the guide RNA and Cas9 compostiions disclosed herein are oncogenic and target mutant sequences in cancer cells to induce efficienct cell death.

Cells that can be targeted by the guide RNA and Cas9 compositions disclosed herein, to in some instances introduce multiple cuts resulting in cell death, include lung cancer cells, breast cancer cells, cervical cancer cells, colon cancer cells, ovarian cancer cells, and pancreatic cancer cells. Cell lines consistent with the compositions and methods disclosd herein include H1299 cells and H1563 cells. The guide RNA and Cas9 compostions disclosed herein are delivered to cells via a variety of methods. The compositions can be electroporated into cells, with or without Lipofectamine, and can also be delivered to cells using a ribonucleoprotein (RNP). Guide RNA and Cas9 compositions can also be delivered using expression vectors, such as the PX459 expression vector.

Illustrative guide RNA sequences are also provided in Table 6 and paragraph [00303] and Table 7 and paragraph [00305] for use with polypeptides comprising Cas12 and Cas9 nucleases, respectively.

In the present disclosure, a guide nucleic acid can refer to a nucleic acid that can hybridize to another nucleic acid, for example, the target polynucleotide in the genome of a cell. In one implementation, a guide nucleic acid can be RNA, for example, a guide RNA. In another implementation, a guide nucleic acid can be DNA. In still another implementation, a guide nucleic acid may include DNA and RNA. Further, a guide nucleic acid can be single stranded or double-stranded. Furthermore, a guide nucleic acid can comprise a nucleotide analog or a modified nucleotide. In an aspect of the present disclosure, the guide nucleic acid can be programmed or designed to bind to a sequence of nucleic acid site-specifically.

In another aspect of the present disclosure, a guide nucleic acid can comprise one or more modifications to provide the nucleic acid with a new or enhanced feature. By way of example, a guide nucleic acid can comprise a nucleic acid affinity tag. Further, a guide nucleic acid can comprise synthetic nucleotide, synthetic nucleotide analog, nucleotide derivatives, and/or modified nucleotides.

In an aspect of the present disclosure, the guide nucleic acid can comprise a nucleic acid-targeting region (e.g., a spacer region), for example, at or near the 5' end or 3' end, that is complementary to a protospacer sequence in a target polynucleotide. The spacer of a guide nucleic acid can interact with a protospacer in a sequence-specific manner via hybridization (base pairing). The protospacer sequence can be located 5' or 3' of protospacer adjacent motif (PAM) in the target polynucleotide. The nucleotide sequence of a spacer region may vary and determine the location for cleavage within the target nucleic acid with which the guide nucleic acid can interact. The spacer region of the guide nucleic acid may be designed or modified to hybridize to any desired sequence within the target nucleic acid.

In another aspect of the present disclosure, a guide nucleic acid can comprise two separate nucleic acid molecules, which can be referred to as a double guide nucleic acid or a single nucleic acid molecule, which can be referred to as a single guide nucleic acid (e.g., sgRNA). In some embodiments, the guide nucleic acid is a single guide nucleic acid comprising a fused CRISPR RNA (crRNA) and a transactivating crRNA (tracrRNA). In some embodiments, the guide nucleic acid is a single guide nucleic acid comprising a crRNA. In some embodiments, the guide nucleic acid is a single guide nucleic acid comprising a crRNA but lacking a tracRNA. In some embodiments, the guide nucleic acid is a double guide nucleic acid comprising non-fused crRNA and tracrRNA. An exemplary double guide nucleic acid can comprise a crRNA-like molecule and a tracrRNA-like molecule. An exemplary single guide nucleic acid can comprise a crRNA-like molecule. An exemplary single guide nucleic acid can comprise a fused crRNA-like molecule and a tracrRNA-like molecule.

A crRNA can comprise the nucleic acid-targeting segment (e.g., spacer region) of the guide nucleic acid and a stretch of nucleotides that can form one half of a double-stranded duplex of the Cas protein-binding segment of the guide nucleic acid.

A tracrRNA can comprise a stretch of nucleotides that forms the other half of the double-stranded duplex of the Cas protein-binding segment of the gRNA. A stretch of nucleotides of a crRNA can be complementary to and hybridize with a stretch of nucleotides of a tracrRNA to form the double-stranded duplex of the Cas protein-binding domain of the guide nucleic acid.

The crRNA and tracrRNA can hybridize to form a guide nucleic acid. The crRNA can also provide a single-stranded nucleic acid targeting segment (e.g., a spacer region) that hybridizes to a target nucleic acid recognition sequence (e.g., protospacer). The sequence of a crRNA, including spacer region, or tracrRNA molecule can be designed to be specific to the species in which the guide nucleic acid is to be used.

In some embodiments, the nucleic acid-targeting region of a guide nucleic acid can be between 18 to 72 nucleotides in length. The nucleic acid-targeting region of a guide nucleic acid (e.g., spacer region) can have a length of from about 12 nucleotides to about 100 nucleotides. For example, the nucleic acid-targeting region of a guide nucleic acid (e.g., spacer region) can have a length of from about 12 nucleotides (nt) to about 80 nt, from about 12 nt to about 50 nt, from about 12 nt to about 40 nt, from about 12 nt to about 30 nt, from about 12 nt to about 25 nt, from about 12 nt to about 20 nt, from about 12 nt to about 19 nt, from about 12 nt to about 18 nt, from about 12 nt to about 17 nt, from about 12 nt to about 16 nt, or from about 12 nt to about 15 nt. Alternatively, the DNA-targeting segment can have a length of from about 18 nt to about 20 nt, from about 18 nt to about 25 nt, from about 18 nt to about 30 nt, from about 18 nt to about 35 nt, from about 18 nt to about 40 nt, from about 18 nt to about 45 nt, from about 18 nt to about 50 nt, from about 18 nt to about 60 nt, from about 18 nt to about 70 nt, from about 18 nt to about 80 nt, from about 18 nt to about 90 nt, from about 18 nt to about 100 nt, from about 20 nt to about 25 nt, from about 20 nt to about 30 nt, from about 20 nt to about 35 nt, from about 20 nt to about 40 nt, from about 20 nt to about 45 nt, from about 20 nt to about 50 nt, from about 20 nt to about 60 nt, from about 20 nt to about 70 nt, from about 20 nt to about 80 nt, from about 20 nt to about 90 nt, or from about 20 nt to about 100 nt. The length of the nucleic acid-targeting region can be at least 5, 10, 15, 16, 17, 18, 19, 20, 21, 22, 23, 24, 25, 30 or more nucleotides. The length of the nucleic acid-targeting region (e.g., spacer sequence) can be at most 5, 10, 15, 16, 17, 18, 19, 20, 21, 22, 23, 24, 25, 30 or more nucleotides.

In some embodiments, the nucleic acid-targeting region of a guide nucleic acid (e.g., spacer) is 20 nucleotides in length. In some embodiments, the nucleic acid-targeting region of a guide nucleic acid is 19 nucleotides in length. In some embodiments, the nucleic acid-targeting region of a guide nucleic acid is 18 nucleotides in length. In some embodiments, the nucleic acid-targeting region of a guide nucleic acid is 17 nucleotides in length. In some embodiments, the nucleic acid-targeting region of a guide nucleic acid is 16 nucleotides in length. In some embodiments, the nucleic acid-targeting region of a guide nucleic acid is 21 nucleotides in length. In some embodiments, the nucleic acid-targeting region of a guide nucleic acid is 22 nucleotides in length.

The nucleotide sequence of the guide nucleic acid that is complementary to a nucleotide sequence (target sequence) of the target nucleic acid can have a length of, for example, at least about 12 nt, at least about 15 nt, at least about 18 nt, at least about 19 nt, at least about 20 nt, at least about 25 nt, at least about 30 nt, at least about 35 nt or at least about 40 nt. The nucleotide sequence of the guide nucleic acid that is complementary to a nucleotide sequence (target sequence) of the target nucleic acid can have a length of from about 12 nucleotides (nt) to about 80 nt, from about 12 nt to about 50 nt, from about 12 nt to about 45 nt, from about 12 nt to about 40 nt, from about 12 nt to about 35 nt, from about 12 nt to about 30 nt, from about 12 nt to about 25 nt, from about 12 nt to about 20 nt, from about 12 nt to about 19 nt, from about 19 nt to about 20 nt, from about 19 nt to about 25 nt, from about 19 nt to about 30 nt, from about 19 nt to about 35 nt, from about 19 nt to about 40 nt, from about 19 nt to about 45 nt, from about 19 nt to about 50 nt, from about 19 nt to about 60 nt, from about 20 nt to about 25 nt, from about 20 nt to about 30 nt, from about 20 nt to about 35 nt, from about 20 nt to about 40 nt, from about 20 nt to about 45 nt, from about 20 nt to about 50 nt, or from about 20 nt to about 60 nt.

A protospacer sequence can be identified by identifying a PAM within a region of interest and selecting a region of a desired size upstream or downstream of the PAM as the protospacer. A corresponding spacer sequence can be designed by determining the complementary sequence of the protospacer region.

A spacer sequence can be identified using a computer program (e.g., machine readable code). The computer program can use variables such as predicted melting temperature, secondary structure formation, and predicted annealing temperature, sequence identity, genomic context, chromatin accessibility, % GC, frequency of genomic occurrence, methylation status, presence of SNPs, and the like.

The percent complementarity between the nucleic acid-targeting sequence (e.g., spacer sequence) and the target nucleic acid (e.g., protospacer) can be at least 60%, at least 70%, at least 75%, at least 80%, at least 85%, at least 90%, at least 95%, at least 97%, at least 98%, at least 99%, or 100%. The percent complementarity between the nucleic acid-targeting sequence and the target nucleic acid can be at least 60%, at least 70%, at least 75%, at least 80%, at least 85%, at least 90%, at least 95%, at least 97%, at least 98%, at least 99%, or 100% over about 20 contiguous nucleotides.

The Cas protein-binding segment of a guide nucleic acid can comprise two stretches of nucleotides (e.g., crRNA and tracrRNA) that are complementary to one another. The two stretches of nucleotides (e.g., crRNA and tracrRNA) that are complementary to one another can be covalently linked by intervening nucleotides (e.g., a linker in the case of a single guide nucleic acid). The two stretches of nucleotides (e.g., crRNA and tracrRNA) that are complementary to one another can hybridize to form a double stranded RNA duplex or hairpin of the Cas protein-binding segment, thus resulting in a stem-loop structure. The crRNA and the tracrRNA can be covalently linked via the 3' end of the crRNA and the 5' end of the tracrRNA. Alternatively, tracrRNA and crRNA can be covalently linked via the 5' end of the tracrRNA and the 3' end of the crRNA.

The Cas protein binding segment of a guide nucleic acid can have a length of from about 10 nucleotides to about 100 nucleotides, e.g., from about 10 nucleotides (nt) to about 20 nt, from about 20 nt to about 30 nt, from about 30 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt. For example, the Cas protein-binding segment of a guide nucleic acid can have a length of from about 15 nucleotides (nt) to about 80 nt, from about 15 nt to about 50 nt, from about 15 nt to about 40 nt, from about 15 nt to about 30 nt or from about 15 nt to about 25 nt.

The dsRNA duplex of the Cas protein-binding segment of the guide nucleic acid can have a length from about 6 base pairs (bp) to about 50 bp. For example, the dsRNA duplex of the protein-binding segment can have a length from about 6 bp to about 40 bp, from about 6 bp to about 30 bp, from about 6 bp to about 25 bp, from about 6 bp to about 20 bp, from about 6 bp to about 15 bp, from about 8 bp to about 40 bp, from about 8 bp to about 30 bp, from about 8 bp to about 25 bp, from about 8 bp to about 20 bp or from about 8 bp to about 15 bp. For example, the dsRNA duplex of the Cas protein-binding segment can have a length from about from about 8 bp to about 10 bp, from about 10 bp to about 15 bp, from about 15 bp to about 18 bp, from about 18 bp to about 20 bp, from about 20 bp to about 25 bp, from about 25 bp to about 30 bp, from about 30 bp to about 35 bp, from about 35 bp to about 40 bp, or from about 40 bp to about 50 bp.

In some embodiments, the dsRNA duplex of the Cas protein-binding segment may have a length of 36 base pairs. The percent complementarity between the nucleotide sequences that hybridize to form the dsRNA duplex of the protein-binding segment can be at least about 60%. For example, the percent complementarity between the nucleotide sequences that hybridize to form the dsRNA duplex of the protein-binding segment can be at least about 65%, at least about 70%, at least about 75%, at least about 80%, at least about 85%, at least about 90%, at least about 95%, at least about 98%, or at least about 99%. In some cases, the percent complementarity between the nucleotide sequences that hybridize to form the dsRNA duplex of the protein-binding segment is 100%.

The linker (e.g., that links a crRNA and a tracrRNA in a single guide nucleic acid) can have a length of from about 3 nucleotides to about 100 nucleotides. For example, the linker can have a length of from about 3 nucleotides (nt) to about 90 nt, from about 3 nucleotides (nt) to about 80 nt, from about 3 nucleotides (nt) to about 70 nt, from about 3 nucleotides (nt) to about 60 nt, from about 3 nucleotides (nt) to about 50 nt, from about 3 nucleotides (nt) to about 40 nt, from about 3 nucleotides (nt) to about 30 nt, from about 3 nucleotides (nt) to about 20 nt or from about 3 nucleotides (nt) to about 10 nt. For example, the linker can have a length of from about 3 nt to about 5 nt, from about 5 nt to about 10 nt, from about 10 nt to about 15 nt, from about 15 nt to about 20 nt, from about 20 nt to about 25 nt, from about 25 nt to about 30 nt, from about 30 nt to about 35 nt, from about 35 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt. In some embodiments, the linker of a DNA-targeting RNA is 4 nt.

As noted above, in an aspect of the present disclosure, guide nucleic acids can include modifications or sequences that provide for additional desirable features (e.g., modified or regulated stability; subcellular targeting; tracking with a fluorescent label; a binding site for a protein or protein complex; and the like). Examples of such modifications include, for example, a 5' cap (a 7-methylguanylate cap (m7G)); a 3' polyadenylated tail (a 3' poly(A) tail); a riboswitch sequence (e.g., to allow for regulated stability and/or regulated accessibility by proteins and/or protein complexes); a stability control sequence; a sequence that forms a dsRNA duplex (a hairpin)); a modification or sequence that targets the RNA to a subcellular location (e.g., nucleus, mitochondria, chloroplasts, and the like); a modification or sequence that provides for tracking (e.g., direct conjugation to a fluorescent molecule, conjugation to a moiety that facilitates fluorescent detection, a sequence that allows for fluorescent detection, and so forth); a modification or sequence that provides a binding site for proteins (e.g., proteins that act on DNA, including transcriptional activators, transcriptional repressors, DNA methyl transferases, DNA demethylases, histone acetyltransferases, histone deacetylases, and combinations thereof.

In another aspect of the present disclosure, a guide nucleic acid can comprise one or more modifications (e.g., a base modification, a backbone modification), to provide the nucleic acid with a new or enhanced feature (e.g., improved stability). A guide nucleic acid can comprise a nucleic acid affinity tag. A nucleoside can be a base-sugar combination. The base portion of the nucleotide can be a heterocyclic base. The two most common classes of such heterocyclic bases are the purines and the pyrimidines. Nucleotides can be nucleosides that further include a phosphate group covalently linked to the sugar portion of the nucleoside. For those nucleosides that include a pentofuranosyl sugar, the phosphate group can be linked to the 2', the 3', or the 5' hydroxyl moiety of the sugar. In forming guide nucleic acids, the phosphate groups can covalently link adjacent nucleosides to one another to form a linear polymeric compound. In turn, the respective ends of this linear polymeric compound can be further joined to form a circular compound; however, linear compounds are generally suitable. In addition, linear compounds may have internal nucleotide base complementarity and may therefore fold in a manner as to produce a fully or partially double-stranded compound. Further, within guide nucleic acids, the phosphate groups may commonly be referred to as forming the internucleoside backbone of the guide nucleic acid. The linkage or backbone of the guide nucleic acid can be a 3' to 5' phosphodiester linkage.

In another aspect of the present disclosure, a guide nucleic acid can comprise a modified backbone and/or modified internucleoside linkages. Modified backbones can include those that retain a phosphorus atom in the backbone and those that do not have a phosphorus atom in the backbone.

Suitable modified guide nucleic acid backbones containing a phosphorus atom therein can include, for example, phosphorothioates, chiral phosphorothioates, phosphorodithioates, phosphotriesters, aminoalkylphosphotriesters, methyl and other alkyl phosphonates such as 3'-alkylene phosphonates, 5'-alkylene phosphonates, chiral phosphonates, phosphinates, phosphoramidates including 3'-amino phosphoramidate and aminoalkylphosphoramidates, phosphorodiamidates, thionophosphoramidates, thionoalkylphosphonates, thionoalkylphosphotriesters, selenophosphates, and boranophosphates having normal 3'-5' linkages, 2'-5' linked analogs, and those having inverted polarity wherein one or more internucleotide linkages is a 3' to 3', a 5' to 5' or a 2' to 2' linkage. Suitable guide nucleic acids having inverted polarity can comprise a single 3' to 3' linkage at the 3'-most internucleotide linkage (such as a single inverted nucleoside residue in which the nucleobase is missing or has a hydroxyl group in place thereof). Various salts (e.g., potassium chloride or sodium chloride), mixed salts, and free acid forms can also be included.

A guide nucleic acid can comprise one or more phosphorothioate and/or heteroatom internucleoside linkages, in particular —CH2-NH—O-CH2-, —CH2-N(CH3)-O-CH2- (a methylene (methylimino) or MMI backbone), —CH2-O—N(CH3)-CH2-, —CH2-N(CH3)-N(CH3)-CH2- and —O—N(CH3)-CH2-CH2- (wherein the native phosphodiester internucleotide linkage is represented as —O—P(=O)(OH)—O-CH2-).

A guide nucleic acid can comprise a morpholino backbone structure. For example, a nucleic acid can comprise a 6-membered morpholino ring in place of a ribose ring. In some of these embodiments, a phosphorodiamidate or other non-phosphodiester internucleoside linkage replaces a phosphodiester linkage.

A guide nucleic acid can comprise polynucleotide backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These can include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; riboacetyl backbones; alkene containing backbones; sulfamate backbones; methyleneimino and methylenehydrazino backbones; sulfonate and sulfonamide backbones; amide backbones; and others having mixed N, O, S and CH2 component parts.

A guide nucleic acid can comprise a nucleic acid mimetic. The term "mimetic" can be intended to include polynucleotides wherein only the furanose ring or both the furanose ring and the internucleotide linkage are replaced with non-furanose groups, replacement of only the furanose ring can also be referred as being a sugar surrogate. The heterocyclic base moiety or a modified heterocyclic base moiety can be maintained for hybridization with an appropriate target nucleic acid. One such nucleic acid can be a peptide nucleic acid (PNA). In a PNA, the sugar-backbone of a polynucleotide can be replaced with an amide containing backbone, in particular an aminoethylglycine backbone. The nucleotides can be retained and are bound directly or indirectly to aza nitrogen atoms of the amide portion of the backbone. The backbone in PNA compounds can comprise two or more linked aminoethylglycine units which gives PNA an amide containing backbone. The heterocyclic base moieties can be bound directly or indirectly to aza nitrogen atoms of the amide portion of the backbone.

A guide nucleic acid can comprise linked morpholino units (morpholino nucleic acid) having heterocyclic bases attached to the morpholino ring. Linking groups can link the morpholino monomeric units in a morpholino nucleic acid. Non-ionic morpholino-based oligomeric compounds can have less undesired interactions with cellular proteins. Morpholino-based polynucleotides can be non-ionic mimics of guide nucleic acids. A variety of compounds within the morpholino class can be joined using different linking groups. A further class of polynucleotide mimetic can be referred to as cyclohexenyl nucleic acids (CeNA). The furanose ring normally present in a nucleic acid molecule can be replaced with a cyclohexenyl ring. CeNA DMT protected phosphoramidite monomers can be prepared and used for oligomeric compound synthesis using phosphoramidite chemistry. The incorporation of CeNA monomers into a nucleic acid chain can increase the stability of a DNA/RNA hybrid. CeNA oligoadenylates can form complexes with nucleic acid complements with similar stability to the native complexes. A further modification can include Locked Nucleic Acids (LNAs) in which the 2'-hydroxyl group is linked to the 4' carbon atom of the sugar ring thereby forming a 2'-C,4'-C-oxymethylene linkage thereby forming a bicyclic sugar moiety. The linkage can be a methylene (—CH2-), group bridging the 2' oxygen atom and the 4' carbon atom wherein n is 1 or 2. LNA and LNA analogs can display very high duplex thermal stabilities with complementary nucleic acid (Tm=+3 to +10° C.), stability towards 3'-exonucleolytic degradation and good solubility properties.

A guide nucleic acid can comprise one or more substituted sugar moieties. Suitable polynucleotides can comprise a sugar substituent group selected from: OH; F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted C1 to C10 alkyl or C2 to C10 alkenyl and alkynyl. Particularly suitable are O((CH2)nO) mCH3, O(CH2)nOCH3, O(CH2)nNH2, O(CH2)nCH3, O(CH2)nONH2, and O(CH2)nON((CH2)nCH3)2, where n and m are from 1 to about 10. A sugar substituent group can be selected from: C1 to C10 lower alkyl, substituted lower alkyl, alkenyl, alkynyl, alkaryl, aralkyl, O-alkaryl or O-aralkyl, SH, SCH3, OCN, Cl, Br, CN, CF3, OCF3, SOCH3, SO2CH3, ONO2, NO2, N3, NH2, heterocycloalkyl, heterocycloalkaryl, aminoalkylamino, polyalkylamino, substituted silyl, an RNA cleaving group, a reporter group, an intercalator, a group for improving the pharmacokinetic properties of an guide nucleic acid, or a group for improving the pharmacodynamic properties of an guide nucleic acid, and other substituents having similar properties. A suitable modification can include 2'-methoxyethoxy (2'-O—CH2CH2OCH3, also known as 2'-O-(2-methoxyethyl) or 2'-MOE, an alkoxyalkoxy group). A further suitable modification can include 2'-dimethylaminooxyethoxy, (a O(CH2)2ON(CH3)2 group, also known as 2'-DMAOE), and 2'-dimethylaminoethoxyethoxy (also known as 2'-O-dimethylamino-ethoxy-ethyl or 2'-DMAEOE), 2'-O-CH2-O-CH2-N(CH3)2.

Other suitable sugar substituent groups can include methoxy (—O—CH3), aminopropoxy (—OCH2CH2CH2NH2), allyl (—CH2-CH=CH2), —O-allyl CH2-CH=CH2) and fluoro (F). 2'-sugar substituent groups may be in the arabino (up) position or ribo (down) position. A suitable 2'-arabino modification is 2'-F. Similar modifications may also be made at other positions on the oligomeric compound, particularly the 3' position of the sugar on the 3' terminal nucleoside or in 2'-5' linked nucleotides and the 5' position of 5' terminal nucleotide. Oligomeric compounds may also have sugar mimetics such as cyclobutyl moieties in place of the pentofuranosyl sugar.

A guide nucleic acid may also include nucleobase (often referred to simply as "base") modifications or substitutions. As used herein, "unmodified" or "natural" nucleobases can include the purine bases, (e.g. adenine (A) and guanine (G)), and the pyrimidine bases, (e.g. thymine (T), cytosine (C) and uracil (U)). Modified nucleobases can include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl (—C≡C—CH3) uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 2-F-adenine, 2-amino-adenine, 8-azaguanine and 8-azaadenine, 7-deazaguanine and 7-deazaadenine and 3-deazaguanine and 3-deazaadenine. Modified nucleobases can include tricyclic pyrimidines such as phenoxazine cytidine (1H-pyrimido(5,4-b)(1,4)benzoxazin-2(3H)-one), phenothiazine cytidine (1H-pyrimido(5,4-b)(1,4)benzothiazin-2(3H)-one), G-clamps such as a substituted phenoxazine cytidine (e.g. 9-(2-aminoethoxy)-H-pyrimido(5,4-(b) (1,4)benzoxazin-2 (3H)-one), carbazole cytidine (2H-pyrimido(4,5-b)indol-2-one), pyridoindole cytidine (H¬pyrido(3',2':4,5)pyrrolo(2,3-d)pyrimidin-2-one).

Heterocyclic base moieties can include those in which the purine or pyrimidine base is replaced with other heterocycles, for example 7-deaza-adenine, 7-deazaguanosine, 2-aminopyridine and 2-pyridone. Nucleobases can be useful for increasing the binding affinity of a polynucleotide compound. These can include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions can increase nucleic acid duplex stability by 0.6-1.2° C. and can be suitable base substitutions (e.g., when combined with 2'-O-methoxyethyl sugar modifications).

A modification of a guide nucleic acid can comprise chemically linking to the guide nucleic acid one or more moieties or conjugates that can enhance the activity, cellular distribution or cellular uptake of the guide nucleic acid. These moieties or conjugates can include conjugate groups covalently bound to functional groups such as primary or secondary hydroxyl groups. Conjugate groups can include, but are not limited to, intercalators, reporter molecules, polyamines, polyamides, polyethylene glycols, polyethers, groups that enhance the pharmacodynamic properties of oligomers, and groups that can enhance the pharmacokinetic properties of oligomers. Conjugate groups can include, but are not limited to, cholesterols, lipids, phospholipids, biotin, phenazine, folate, phenanthridine, anthraquinone, acridine, fluoresceins, rhodamines, coumarins, and dyes. Groups that enhance the pharmacodynamic properties include groups that improve uptake, enhance resistance to degradation, and/or strengthen sequence-specific hybridization with the target nucleic acid. Groups that can enhance the pharmacokinetic properties include groups that improve uptake, distribution, metabolism or excretion of a nucleic acid. Conjugate moieties can include but are not limited to lipid moieties such as a cholesterol moiety, cholic acid a thioether, (e.g., hexyl-S-tritylthiol), a thiocholesterol, an aliphatic chain (e.g., dodecandiol or undecyl residues), a phospholipid (e.g., di-hexadecyl-rac-glycerol or triethylammonium 1,2-di-O-hexadecyl-rac-glycero-3-H-phosphonate), a polyamine or a polyethylene glycol chain, or adamantane acetic acid, a palmityl moiety, or an octadecylamine or hexylamino-carbonyl-oxycholesterol moiety.

A modification may include a Protein Transduction Domain or PTD (a cell penetrating peptide (CPP)). The PTD can refer to a polypeptide, polynucleotide, carbohydrate, or organic or inorganic compound that facilitates traversing a lipid bilayer, micelle, cell membrane, organelle membrane, or vesicle membrane. A PTD can be attached to another molecule, which can range from a small polar molecule to a large macromolecule and/or a nanoparticle, and can facilitate the molecule traversing a membrane, for example going from extracellular space to intracellular space, or cytosol to within an organelle. A PTD can be covalently linked to the amino terminus of a polypeptide. A PTD can be covalently linked to the carboxyl terminus of a polypeptide. A PTD can be covalently linked to a nucleic acid.

Exemplary PTDs can include, but are not limited to, a minimal peptide protein transduction domain; a polyarginine sequence comprising a number of arginines sufficient to direct entry into a cell (e.g., 3, 4, 5, 6, 7, 8, 9, 10, or 10-50 arginines (SEQ ID NO: 234)), a VP22 domain, a *Drosophila* Antennapedia protein transduction domain, a truncated human calcitonin peptide, polylysine, and transportan, arginine homopolymer of from 3 arginine residues to 50 arginine residues (SEQ ID NO: 234). The PTD can be an activatable CPP (ACPP). ACPPs can comprise a polycationic CPP (e.g., Arg9 or "R9" (SEQ ID NO: 63)) connected via a cleavable linker to a matching polyanion (e.g., Glu9 or "E9" (SEQ ID NO: 64)), which can reduce the net charge to nearly zero and thereby inhibits adhesion and uptake into cells. Upon cleavage of the linker, the polyanion can be released, locally unmasking the polyarginine and its inherent adhesiveness, thus "activating" the ACPP to traverse the membrane.

An exemplary chimeric polypeptide of the present disclosure comprises a nuclease such as a site-specific endonuclease or a domain thereof. Non-limiting exemplary site-specific endonucleases that are suitable with the present disclosure may include but are not limited to CRISPR-associated (Cas) polypeptides or Cas nucleases including Class 1 Cas polypeptides, Class 2 Cas polypeptides, type I Cas polypeptides, type II Cas polypeptides, type III Cas polypeptides, type IV Cas polypeptides, type V Cas polypeptides, and type VI CRISPR-associated (Cas) polypeptides; zinc finger nucleases (ZFN); transcription activator-like effector nucleases (TALEN); meganucleases; RNA-binding proteins (RBP); CRISPR-associated RNA binding proteins; recombinases; flippases; transposases; Argonaute (Ago) proteins (e.g., prokaryotic Argonaute (pAgo), archaeal Argonaute (aAgo), and eukaryotic Argonaute (eAgo)); any derivative thereof any variant thereof and any fragment thereof.

In some cases, a chimeric polypeptide of the present disclosure comprises one or more domains of a site-specific endonuclease. Non-limiting examples of domains suitable for use with the present disclosure may include guide nucleic acid recognition or binding domain; nuclease domains such as DNase domain, RNase domain, RuvC domain, and HNH nuclease domain; DNA binding domain; RNA binding domain; helicase domains; protein-protein interaction domains; and dimerization domains. A guide nucleic acid recognition or binding domain interacts with a guide nucleic acid. A nuclease domain comprises catalytic activity for nucleic acid cleavage. Alternatively, a nuclease domain may be a mutated nuclease domain that lacks or has reduced catalytic activity. A site-specific endonuclease may be a chimera of various site-specific endonuclease proteins, for example, comprising domains from different Cas proteins.

In some cases, a site-specific endonuclease of the present disclosure is a wild-type form of the protein. Alternatively, a site-specific endonuclease is a modified version of the wildtype form, for example, comprising an amino acid change such as a deletion, insertion, substitution, variant, mutation, fusion, chimera, or any combination thereof, relative to a wild-type version of the protein.

In some cases, a site-specific endonuclease of the disclosure comprises a polypeptide with at least about 5%, 10%, 20%, 30%, 40%, 50%, 60%, 70%, 80%, 90%, 91%, 92%, 93%, 94%, 95%, 96%, 97%, 98%, 99%, or 100% sequence identity to a wild type exemplary site-specific endonuclease.

In some cases, a site-specific endonuclease of the disclosure comprises an amino acid sequence having at least about 5%, 10%, 20%, 30%, 40%, 50%, 60%, 70%, 80%, 90%, 91%, 92%, 93%, 94%, 95%, 96%, 97%, 98%, 99%, or 100% sequence identity to a nuclease domain, for example, a RuvC domain or an HNH domain, of a wild-type site-specific endonuclease.

Proteins that bind to and are guided by a guide RNA to direct sequence specific cleavage or that, otherwise, bind nucleic acid sequences in a sequence specific way to trigger non-specific cleavage are consistent with the present disclosure. Said proteins include programmable endonucleases, such as programmable Cas endonucleases. In some cases, a site-specific endonuclease of the disclosure comprises a Cas polypeptide or a domain thereof. Non-limiting exemplary Cas polypeptides suitable for use with the present disclosure include Cas9, Cpf1 (or Cas12a), c2c1, C2c2 (or Cas13a), Cas13, Cas13a, Cas13b, c2c3, Cas1, Cas1B, Cas2, Cas3, Cas4, Cas5, Cas5e (CasD), Cas6, Cas6e, Cas6f, Cas7, Cas8a, Cas8a1, Cas8a2, Cas8b, Cas8c, Csn1, Csx12, Cas10, Cas10d, Cas1O, Cas1Od, CasF, CasG, CasH, Csy1, Csy2, Csy3, Cse1 (CasA), Cse2 (CasB), Cse3 (CasE), Cse4 (CasC), Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx1O, Csx16, CsaX, Csx3, Csx1, Csx15, Csf1, Csf2, Csf3, Csf4, and Cu1966; any derivative thereof; any variant thereof; and any fragment thereof.

In some cases, a site-specific endonuclease of the present disclosure comprises inducible non-specific nuclease activity or promiscuous activity in addition to target-specific activity. The non-specific activity may be activated by site-specific cleavage of the target nucleic acid by the site-specific endonuclease. Non-limiting exemplary site-specific endonucleases comprising inducible non-specific nuclease activity may include Cas12a (Cpf1), Cas13, C13a, and Cas13b.

In some cases, a site-specific endonuclease may include a Cas9 polypeptide, including any derivative thereof; any variant thereof; and any fragment thereof. Cas9 is classified as a class II, Type II CRISPR/Cas effector protein. An exemplary Cas9 polypeptide is Cas9 from *Streptococcus pyogenes*, referred to herein as SpCas9, which is composed of 1,368 amino acids. Cas9 is characterized to have two endonuclease domains, HNH and RuvC, and a recognition lobe (REC) domain. The HNH domain cleaves the DNA strand complementary to the guide RNA sequence. The RuvC-like domain cuts the other non-complementary DNA strand through Watson-Crick base pairing formed by a guide RNA/Cas9 complex.

In some cases, a Cas9 protein comprises mutations. For example, substitution of aspartic acid (D) at the $10^{th}$ amino acid in the RuvC domain to alanine (A) removes the RuvC-dependent nuclease function leaving only HNH-dependent endonuclease function. The D10A variant of Cas9, known as a nickase, can be used to generate a single strand nick at the target site. An additional substitution mutation, a change from histidine (H) to alanine (A) at the $840^{th}$ amino acid in HNH domain of Cas9 H840A, produces a deactivated Cas9 protein lacking all nuclease activity. The deactivated Cas9, comprising mutations D10A and H840A, retains sequence-specific binding function and can serve as a functional transcription factor, for example, when fused in frame with either an activator or a repressor domain.

Proteins that bind to and are guided by a guide RNA to direct sequence specific cleavage or that, otherwise, bind nucleic acid sequences in a sequence specific way to trigger non-specific cleavage are consistent with the present disclosure. Said proteins include programmable endonucleases, such as programmable Cas endonucleases. Examples of programmable Cas endonucleases consistent with the present disclosure include Cas12a (or Cpf1), Cas12a, Cas12b, Cas12c, Cas12d, Cas12e, Cas12f, Cas12g, Cas12h, Cas12i, Cas13a, Cas13b, Cas14, Cas9, or others. In some cases, a site-specific endonuclease may include Cas12a (Cpf1), including any derivative thereof, any variant thereof; and any fragment thereof. Cas12a is classified as a class II, Type V CRISPR/Cas effector protein having about 1,300 amino acids. Cas12a is smaller than Cas9. Cas12a comprises two major domains such as REC and RuvC domains. Cas12a lacks the HNH endonuclease domain as in Cas9. Cas12a cleaves a double stranded DNA (dsDNA) immediately downstream from T-rich (5'-TTTN-3') PAM. Cas12a generates a 4-5 nt-long 5'-overhang 20 nucleotides away from T-rich PAM. In some cases, the sticky ends produced by Cas12a enhance the efficiency of DNA replacement during HR.

In some cases, a site-specific endonuclease may include Cas13a (C2c2). Alternatively, in some cases, a site-specific endonuclease may include Cas13b. Cas13 is an RNA-targeting endonuclease that exhibits a collateral effect of promiscuous RNAs activity upon target recognition.

In some cases, a site-specific endonuclease such as a Cas polypeptide may be from the organism *Streptococcus pyogenes* (*S. pyogenes*). Alternatively, a number of eubacterial or other microbial organisms may be suitable sources for site specific endonucleases such as Cas polypeptides. Source organisms are selected by any number of criteria, such as GC bias or codon bias of their encoded proteins, optimal growth temperature (which often corresponds to enzyme optimal activity), availability, presence of regulatory sites, or other relevant criteria. Any of the following non-limiting examples are suitable for use as a source of the site-specific endonuclease: *Leptotrichia wadei, Leptotrichia shahii, Streptococcus thermophilus, Streptococcus* sp., *Staphylococcus aureus, Nocardiopsis dassonvillei, Streptomyces pristinae spiralis, Streptomyces viridochromo* genes, *Streptomyces viridochromogenes, Streptosporangium roseum, Streptosporangium roseum, Alicyclobacillus acidocaldarius, Bacillus pseudomycoides, Bacillus selenitireducens, Exiguobacterium sibiricum, Lactobacillus delbrueckii, Lactobacillus salivarius, Microscilla marina, Burkholderiales bacterium, Polaromonas naphthalenivorans, Polaromonas* sp., *Crocosphaera watsonii, Cyanothece* sp., *Microcystis aeruginosa, Pseudomonas aeruginosa, Synechococcus* sp., *Acetohalobium arabaticum, Ammonifex degensii, Caldicelulosiruptor becscii, Candidatus Desulforudis, Clostridium botulinum, Clostridium difficile, Finegoldia magna, Natranaerobius thermophilus, Pelotomaculum thermopropionicum, Acidithiobacillus caldus, Acidithiobacillus ferrooxidans, Allochromatium vinosum, Marinobacter* sp., *Nitrosococcus halophilus, Nitrosococcus watsoni, Pseudoalteromonas haloplanktis, Ktedonobacter racemifer, Methanohalobium evestigatum, Anabaena variabilis, Nodularia spumigena, Nostoc* sp., *Arthrospira maxima, Arthrospira platensis, Arthrospira* sp., *Lyngbya* sp., *Microcoleus chthonoplastes, Oscillatoria* sp., *Petrotoga mobilis, Thermosipho africanus, Acaryochloris marina, Leptotrichia shahii, Prevotella,* or *Francisella novicida.* Other source organisms are consistent with the present disclosure herein.

Some exemplary chimeric polypeptides of the present disclosure may comprise an exonuclease or a domain thereof. Non-limiting examples of exonucleases suitable for use with the present disclosure include exonucleases such as 5'-3' exonucleases, 3'-5' exonucleases, and 5'-3' alkaline exonucleases. Table 3 shows exemplary exonucleases suitable for fusion with a site-specific endonuclease to generate a chimeric polypeptide of the present disclosure.

TABLE 3

Exemplary Exonucleases

| Added moieties | Origin of added domain | Function of added moieties |
|---|---|---|
| RecE | *Escherichia coli* | 5' → 3' exonuclease |
| RecJ | *Escherichia coli* | 5' → 3' exonuclease |
| T5 | Bacteriophage T5 | 5' → 3' exonuclease |
| Exo I | Prokaryote & enukaryote | 3' → 5' exonuclease |
| Exo III | *Escherichia coli* | 3' → 5' exonuclease |
| Exo VII | *Escherichia coli* | Both 5' → 3' and 3' → 5' directions. |
| Lexo | *Escherichia coli* | Lambda exonuclease, 5' → 3' exonuclease |
| RecBCD | *Escherichia coli* | Both 5'→ 3' and 3' → 5' directions |
| Exo T | *Escherichia coli* | 3' → 5' exonuclease |
| Trex1 | *Homo sapiens* | 3' → 5' exonuclease |
| Trex2 | *Homo sapiens* | 3' → 5' exonuclease |
| Mungbean | *Vigna radiata* | Single strand DNA digestion |

In an exemplary chimeric polypeptide, the exonuclease comprises a 5'-3' exonuclease or a catalytic domain thereof. Non-limiting examples of 5'-3' exonucleases suitable for use with the disclosure include those from prokaryotes such as RecE, RecJ, RexB, and the exonuclease domain of DNA Polymerase I; bacteriophages such as T2, T3, T4, T5, T7, or lambda bacteriophage; and eukaryotes such as Xrn1 or Exo1 5'-exonuclease. In some cases, the mutation efficiency achieved with a chimeric polypeptide comprising 5'-3' exonuclease activity is greater than that achieved with a chimeric polypeptide comprising 3'-5' exonuclease activity.

In an exemplary chimeric polypeptide, the exonuclease may comprise RecJ or a catalytic domain thereof. RecJ is a processive monomeric exonuclease of about 60 kD. RecJ degrades ssDNA in a 5' to 3' polarity in a reaction that requires Mg2+, resulting in degradation of DNA to mononucleotides. RecJ nuclease can produce ssDNA with 3' overhang tails which may be bound by a single-stranded DNA binding protein. In some cases, RecJ does not require a terminal 5' phosphate and will digest equally well DNA terminating in 5' OH. In some cases, RecJ has no activity on blunt dsDNA. In some cases, RecJ requires at least 6 unpaired bases to bind and to initiate degradation. Once bound to a ssDNA-tailed molecule, RecJ can digest into a dsDNA region to a limited extent but most often terminates digestion at the ds/ssDNA boundary. RecJ is specialized for degradation from a single-strand gap, then leads to produce 3' ssDNA tailed recombinogenic molecules from double-strand ends. RecJ can remove 5' overhanging ssDNA produced by 3' to 5' exonuclease activity to increase the indel mutation rate. In some cases, RecJ is suited to link to C-terminus of a site-specific endonuclease such as Cpf1, for example, because RecJ is capable of chewing 5-nt overhang produced by Cpf1.

In an exemplary chimeric polypeptide, the exonuclease may comprise RecE or a domain thereof. RecE (also known as Exonuclease VIII or ExoVIII) possesses processive Mg2+-dependent 5' to 3' exonuclease activity. RecE is the functional equivalent to the lambda exonuclease. An exemplary source of RecE is *E. coli*. RecE is composed of about 866 amino acids. RecE resects double stranded DNA from 5' to 3' direction. RecE requires a 5' phosphate for its exonuclease activity. In some cases, RecE preferentially acts on dsDNA blunt ends, which are produced by site-specific endonucleases such as Cas9.

In an exemplary chimeric polypeptide, the exonuclease may comprise T5 exonuclease or a catalytic domain thereof. T5 exonuclease (T5-exo) is a 276 amino acid protein. T5 exonuclease has a 5'→3' exodeoxyribonuclease activity. T5 exonuclease degrades ssDNA or dsDNA in the 5' to 3' direction. T5 exonuclease is able to initiate nucleotide removal from the 5' termini or at gaps and nicks of linear or circular dsDNA. Some T5 exonuclease moieties do not degrade supercoiled circular dsDNA. T5 exonuclease can enhance indel mutation and HR by producing 3'-overhangs from double strand breaks generated by a site-specific endonuclease such as Cas9.

In an exemplary chimeric polypeptide, the exonuclease may comprise Lambda exonuclease or a catalytic domain thereof. Lambda exonuclease belongs to exonuclease IV, which has exonucleolytic cleavage in the 5'- to 3'-direction to yield nucleoside 5'-phosphates. Lambda exonuclease has a preference for blunt-ended, 5'-phosphorylated dsDNA. Lambda Exonuclease is unable to initiate DNA digestion at nicks or gaps. Lambda Exonuclease can enhance both the indel mutation rate and HR by producing 3' overhangs from Cas9-produced blunt ends.

In an exemplary chimeric polypeptide, the exonuclease may comprise an exonuclease domain of DNA polymerase I. Cleavage of DNA polymerase I, for example, by the protease subtilisin, produces a small fragment and a large fragment (also known as the Klenow fragment). The small fragment, referred to herein as small fragment of DNA pol I, comprises 5'→3' exonuclease and 5' flap (5' overhang extending from duplex strands) endonuclease activity, and is suitable for use as a DME comprising 5'→3' exonuclease activity. The larger fragment comprises 5'→3' polymerase activity, and 3'→5' exonuclease activity.

In an exemplary chimeric polypeptide, the exonuclease may comprise a 3'-5' exonuclease or a catalytic domain thereof. Non-limiting examples of 3'-5' exonucleases suitable for use with the present disclosure may include TREX such as TREX2, Mungbean nuclease, Exonuclease I, Exonuclease III, Exonuclease VII, and RecBCD exonuclease.

In an exemplary chimeric polypeptide, the exonuclease may comprise TREX or a catalytic domain thereof. The TREX enzyme can be TREX1 or TREX2. TREX2 is an autonomous eukaryotic exonuclease, which is a 279 amino acid protein. The TREX1 and TREX2 proteins form homodimers with 3' excision activities. TREX1 and TREX2 employ single-stranded oligonucleotides, and most closely relate structurally with the bacterial epsilon subunit of DNA pol III, ExoI, and ExoX.

In an exemplary chimeric polypeptide, the exonuclease may comprise Mungbean nuclease or a catalytic domain thereof. Mungbean nuclease is a 355 amino acid protein, isolated from the sprouts of the mung bean, *Vigna radiata*. Mungbean nuclease cleaves nucleotides in a step-wise manner from ssDNA or a flap structure of dsDNA with a free single-stranded 5'-end. In some cases, Mungbean exonuclease does not digest double-stranded DNA, double-stranded RNA, DNA/RNA hybrids, or the intact strand of nicked duplex DNA. Mungbean nuclease catalyzes the specific degradation of single-stranded DNA or RNA, and produces mono and oligonucleotides carrying a 5'-P terminus. In some cases, Mungbean exonuclease increases indel mutation by removing 5' and 3' single-stranded overhangs produced by site-specific endonucleases such as Cas9.

In an exemplary chimeric polypeptide, the exonuclease may comprise Exonuclease I (Exo I) or a catalytic domain thereof. Exonuclease I is an 846 amino acid protein with a $Mg^{2+}$-dependent 3' to 5' single strand exonuclease activity. Exonuclease I digests dsDNA to mononucleotides. Exonuclease I is a member of the DnaQ superfamily and its structure is similar to the 3' to 5' exonucleases active site of the Klenow fragment of DNA polymerase I. In some cases, Exonuclease I increases the indel mutation by removing single stranded overhang in double strand break ends produced by site-specific endonucleases such as Cas9.

In an exemplary chimeric polypeptide, the exonuclease may comprise exonuclease III (ExoIII) or a catalytic domain thereof. Exonuclease III catalyzes the stepwise removal of mononucleotides from 3'-hydroxyl termini of double-stranded DNA. Exemplary substrates of exonuclease III are blunt or recessed 3'-termini. In some cases, Exonuclease III also acts at nicks in duplex DNA to produce single-strand gaps, which can be resistant to cleavage, because often Exonuclease III may not be active on 3'-overhang termini with extensions 4 bases or longer being frequently resistant to cleavage. Exonuclease III produces unidirectional deletions from a linear molecule with one 3'-overhang resistant and one 5'-overhang or blunt susceptible terminus. Exonuclease III activity depends partially on the DNA helical structure and displays sequence dependence (C>A=T>G). Exonuclease III can also comprise RNase H, 3'-phosphatase and AP-endonuclease activities. In some cases, Exonuclease III increases indel mutations by accelerating the 3' to 5' exonuclease activity of Cas9.

In an exemplary chimeric polypeptide, the exonuclease may comprise exonuclease VII or a catalytic domain thereof. Exonuclease VII (ExoVII) cleaves single-stranded DNA from either 5'-3' or 3'-5' direction to yield 5'-phosphomononucleotides. Exonuclease VII also comprises an N-terminal DNA binding domain. In some cases, Exonuclease VII increases indel mutations by removing single stranded overhangs generated by Cas9-producing break ends.

In an exemplary chimeric polypeptide, the exonuclease may comprise RecBCD exonuclease or a catalytic domain thereof. RecBCD exonuclease comprises a $Mg^{2+}$-dependent RecB domain, RecC domain, and RecD domain, which unwind dsDNA and degrade single-stranded DNA and double-stranded DNA. RecBCD cleaves ssDNA from either 5'-3' or 3'-5' direction to yield 5'-phosphomononucleotides. In some cases, RecBCD increases indel mutation by removing single-stranded overhangs generated in Cas9-based double strand breaks.

In another example, the exonuclease may comprise Exonuclease T or a catalytic domain thereof. Exonuclease T (Exo T) includes a 215 amino acid protein, a member of the DnaQ-like 3'-5' exonucleases, with a DEDDh domain that contains four acidic DEDD residues (D23, E25, D125, and D186) for binding of two magnesium ions, and a histidine residue (H181) for functioning in the active site of 3'-hydroxyl terminus. Exonuclease T trims the 3' end of structured DNA, including bulge, bubble, and Y-structured DNA.

Routes of administration. Nuclease ribonucleoprotein complexes may be administered through a number of administration routes consistent with the present disclosure herein. Administration is in some cases systemic, through oral administration of a formulation configured to be resistant to digestive uptake. Alternately, systemic administration is achieved through inhalation or through intravenous administration of a complex, such as through introduction of a formulation into the blood stream via injection or via intravenous drip.

Local administration may also be consistent with the present disclosure herein. Compositions are injected, topically administered at a site of affected cells as part of a salve or as a constituent of a patch, for example.

Administration is often impacted by the type of nucleic acids to be targeted. Melanomas, squamous cell carcinomas, skin infections or other accessible surface disorders are optionally subjected to topical or systemic administration. Palpable tumors may be subjected to topical administration or to injection of pre-assembled complexes at or near a tumor site, or may be subjected to systemic administration. Similarly, disorders involving lungs may be addressed through inhalation or through systemic delivery. Internal disorders, disorders involving remote tissues, or conditions where metastasis is suspected such that a cancer cell population is not expected to be localized at a single site are likely to be addressed using a delivery route that comprises at least some systemic delivery.

Further, in an aspect of the present disclosure, the administration may be performed via using nanoparticles as delivery platforms. By way of example, the administration may be done by using for example PEGylated Gold Nanoparticles, anionic gold nanoparticles, and certain polymers for systematic administration non-immune applications, and the administration may be done by using for example lipid-based nanoparticles and certain polymers for immune, vaccines and other applications wherein immune-stimulation is desired. In each of the delivery platforms, both immunotoxicity of both active pharmaceutical ingredient (API) and nanocarrier may be considered and an appropriate delivery system may be selected for a particular application. That is, when immunomodulation is desired, immunologically reactive carrier is used, and when immunoactivity is not desired, the immunologically reactive carrier is not used. As such, nanotechnology-formulated drugs may be developed and used for the present disclosure, based on pre-clinical immunotoxicity studies, for example, available in Dobrovolskaia M, J Control Release. 2015 Dec. 28; 220(0 0): 571-583 (ncbi.nlm.nih.gov/pmc/articles/PMC4688153/), which is incorporated herein in its entirety.

Multiple routes of administration to address a single disorder, performed concurrently or in sequence, are also consistent with the disclosure herein.

Temporal regulation of nuclease activity. As mentioned above, nuclease sequence specificity is optionally accompanied by temporal regulation of nuclease activity so as to further reduce off-target or other side-effects of administration. In an aspect of the present disclosure, temporal regulation is achieved through temporal, specific inactivation of nuclease complexes by at least one of enzymatic inactivation and sequestration via antibody binding. Temporal inactivation conveys the benefit of clearing the nuclease from an individual, either locally or systemically, so as to reduce the risk of off-target activity, particularly in situations where targeted nucleic acids are largely or completely cleared from an individual or a particular site at an individual.

As discussed above, some compositions and methods comprise temporal regulation of activity through administration of a treatment or composition that impacts at least one of nucleic acid recognition, endonucleolytic activity and exonucleolytic activity or other activity consistent with the present disclosure herein. An individual is subjected to a method or administered a composition consistent with the present disclosure herein and is administered a concurrent or follow-on composition or treatment so as to inactivate the nuclease-activity composition. An exemplary inactivating composition includes, but not limited to, $ZnSO_4$ or other ionic or nonionic molecule that impacts sequence identification or nuclease activity. Administration of such a composition impacts nuclease activity such that, even if it remains intact locally or systemically, the nuclease activity is reduced.

By way of example, a "quencher solution" or "stopper solution" as used in the present disclosure may include a composition that inhibits the nuclease activity and the quencher solution may include such as ZnSO4 or other ionic or nonionic modules. For example, depending upon a specific application, a quencher solution may be selected from various quencher solutions available as shown in Table 4, attached hereto, providing a possible combination table for prospective quencher solutions. In Table 4, columns stand for twelve anions (e.g., sulfate, nitrate, chloride, ammonium, citrate, arsenate, phosphate, ammonium phosphate, carbonate, fluoride, oxalate, hydroxide), which are able to ion-bind to metal cations, and rows stand for seven metal ions (e.g., Aluminum, Zinc, Iron, Lead, Copper, Silver, and Gold). Each combination between anions and metal ions is a prospective quencher to terminate CRISPR or CRISPR PLUS™ performance. All 84 quencher solutions are generated from seven metals and twelve anions. Less reactive metal cations, aluminum, zinc, iron, lead, copper, silver, and gold can displace magnesium, which is a crucial cofactor of CRISPR or CRISPR PLUS™ endonuclease activity to perform DNA cleavage reaction. Anions are available to deplete magnesium from Cas9 protein by binding to magnesium.

Table 4, below, illustrates that the metals (e.g., aluminum, zinc, iron, lead, copper, silver, and gold) can be combined with any of the following anions: sulfate ($SO_4$), nitrate ($NO_3$), chloride (Cl), ammonium ($NH_4$), citrate ($C_6H_8O_7$), arsenate ($AsO_4$), phosphate ($PO_4$), ammonium phosphate ($NH_4)_3PO_4$, carbonate ($CO_3$), fluoride (F), oxalate ($C_2O_4$), and hydroxide (OH).

TABLE 4

A combination table for prospective quencher solutions

| Metals | Anions | | | | | | |
|---|---|---|---|---|---|---|---|
| | Sulfate ($SO_4$) | Nitrate ($NO_3$) | Chloride (Cl) | Ammonium ($NH_4$) | Citrate ($C_6H_8O_7$) | Arsenate ($AsO_4$) | Phosphate ($PO_4$) |
| Aluminum | available | available | available | available | available | available | available |
| Zinc | available | available | available | available | available | available | available |
| Iron | available | available | available | available | available | available | available |
| Lead | available | available | available | available | available | available | available |
| copper | available | available | available | available | available | available | available |
| Silver | available | available | available | available | available | available | available |
| Gold | available | available | available | available | available | available | available |

| Metals | Anions | | | | |
|---|---|---|---|---|---|
| | ammonium phosphate $(NH_4)_3PO_4$ | carbonate ($CO_3$) | fluoride (F) | Oxalate ($C_2O_4$) | Hydroxide (OH) |
| Aluminum | available | available | available | available | available |
| Zinc | available | available | available | available | available |
| Iron | available | available | available | available | available |
| Lead | available | available | available | available | available |
| copper | available | available | available | available | available |
| Silver | available | available | available | available | available |
| Gold | available | available | available | available | available |

Additional embodiments include but are not limited to endonuclease-killing nucleic acids that stably bind the nuclease such as CRISPR/Cas or CRISPR PLUS™ complex, rendering it unable to processively degrade nucleic acid substrate in a target-directed manner.

In an aspect of the present disclosure, both inactivation and sequestration of nuclease nucleoprotein complexes may be accomplished through administration of at least one complex-binding antibody. Such an antibody may, in various embodiments, block or impair substrate binding, block or interfere with endonuclease activity, block or interfere with exonuclease activity, or sequester ribonuclear complexes such that they are removed from the vicinity of nucleic acids in a tissue. Accordingly, an antibody may bind and impact, up to and including inactivating, a complex responsible for specific nucleic acid identification or targeted degradation.

In some cases, such a composition may be administered locally at a site of a tumor being targeted for selective nucleic acid degradation, either through injection, topical administration, or co-administration with the nuclease, optionally though a time-delayed release mechanism such as those known in the art. Alternately or in combination, such a composition is administered systemically, optionally in a sequestered from so as to be released or rendered available for activity in a limited range of tissues.

Alternately or in combination, local inactivation of nuclease is achieved through local heat administration at a tumor or other nuclease activity site. Heat administration in various cases may decrease nucleic acid base pairing efficiency, reduce nuclease ribonucleoprotein complex stability, or reduce nuclease ribonucleoprotein activity.

Co-administration and ongoing monitoring or treatment regimens. Nuclease compositions disclosed herein, such as ribonucleoprotein complexes, are administered to an individual as part of a stand-alone treatment regimen or in combination with at least one additional treatment regimen. In particular, an individual suspected or diagnosed as having a particular cancer is often administered a standard of care chemotherapeutic or radiotherapeutic as a first line of treatment, and is administered a composition as disclosed herein as a follow-on or secondary treatment. Such a treatment is in some cases to address deficiencies in an outcome from a primary treatment, or to serve as a confirmatory treatment to increase the likelihood of tumor or disease cell clearance, reducing the chance of relapse after remission.

Also contemplated is administration of a specific nuclease as disclosed herein concurrently with a frontline or conventional treatment, in some cases under conditions so as to convey a benefit of the conventional treatment but at a dose that reduces the side effects of the frontline treatment.

Composition administration in concert with or subsequent to a non-pharmaceutical treatment regimen, such as a surgical intervention is also contemplated, as is administration in combination with an antibiotic regimen, an exercise regimen or a modification to diet.

Alternately, in some cases a nuclease composition herein is administered as a frontline or initial treatment, so as to ameliorate or eliminate the side effects that often accompany chemotherapeutic or radiotherapeutic treatment regimens currently in use as cancer therapeutics.

Also contemplated herein is composition administration in combination with inhibitors of DNA double strand break repair. Inhibitors contemplated for use include small molecule inhibitors and macromolecular inhibitors, for example, a ribonucleoprotein complex comprising a guide nucleic acid that targets a gene associated with DNA double strand break repair such as BRCA gene or BRCA pathway. Inhibitors can be administered concurrently with, prior to, or subsequent to, administration of a composition of the disclosure.

Compositions herein are administered either as a single dose or as part of a multidose regimen. Multidose regimens are often accompanied by ongoing monitoring of treatment efficacy, so as to assess impact on cell proliferation, disease cell count, tumor growth, or impact on disease or cancer symptom amelioration, among other outputs. Accordingly, treatment regimens are often adjusted in light of ongoing efficacy outcomes. Unfavorable treatment outcomes are addressed by, variously, increasing treatment dose, increasing treatment efficacy, or by changing or adding an additional target to a nuclease treatment regimen. Addition or alteration of accompanying treatment compositions is also contemplated and consistent with the disclosure herein.

As discussed above, some treatment regimens initially employ compositions directed to a known target sequence, switching to or supplementing with a target sequence identified de novo through tumor or other cancerous tissue sequencing when treatment outcome is not found to be leading to cancer clearance.

Table 5a shows illustrative gRNA sequences with a handle and T7 RNA polymerase promoter sequences and illustrative output information obtained using a Cas12a nuclease. Table 5b shows illustrative gRNA sequences with a handle, tracrRNA, and T7 RNA polymerase promoter sequences and illustrative output information obtained using a Cas9 nuclease. Table 6 and paragraph [00303] lists illustrative guide RNA sequences, which can be used to guide a polypeptide comprising a Cas12a nuclease domain (e.g., a chimeric polypeptide comprising a Cas12a nuclease) to a target nucleic acid associated with a cancer, for example, lung cancer or pancreatic cancer. Table 7 and paragraph [00305] lists illustrative guide RNA sequences, which can be used to guide a polypeptide comprising a Cas9 nuclease domain (e.g., a chimeric polypeptide comprising a Cas9 nuclease) to a target nucleic acid associated with a cancer, for example, lung cancer or pancreatic cancer. Variations from a reference sequence (e.g., wild type, healthy, or non-cancerous) are indicated in Table 5-Table 7 in underlined text.

Turning to the Figures, one sees the following.

At FIG. 1, CRISPR PLUS™ complexes are shown to be activated by gRNA-guided target site binding, which subsequently activate non-specific nuclease function. Degradation of DNA/RNA results in demolition of cancer cells. FIG. 1 shows a schematic of CRISPR PLUS™ complexes and a target nucleic acid (e.g., ds DNA and ss RNA). In each schematic, a portion of the guide RNA (gRNA) anneals to a target sequence, which is upstream of, and adjacent to, the protospacer adjacent motif (PAM).

At top, the action on double-stranded DNA is shown. A target sequence is identified, endonucleic cleavage resulting in a double-stranded break directed by binding to the target sequence is effected, and exonuclease activity amplifies the break to form a substantial lesion in the nucleic acid molecule leading to cell death.

At bottom, a complex identifies a target sequence in a ribonucleic acid molecule. The complex is activated and the RNA molecule is degraded.

At FIG. 2, the activation of the non-specific nuclease function of CRISPR PLUS™ is observed in cancer cells. A CRISPR PLUS™ complex is administered to an individual having a heterogeneous cell population. In this population, a mutation is identified as being associated with cell proliferation. Cells harboring this mutation are targeted for degradation. A ribonucleoprotein complex harboring a guide RNA that identifies the target mutation is assembled and administered to the individual. At left, one sees that cells lacking the mutation (no target sequence) are unaffected, because no target sequence is identified and no cell nucleic acid degradation occurs. At right, one sees that cells harboring the mutation (cancer specific sequence) are subjected to nucleic acid degradation. The guide RNA identifies the target mutation and directs endonuclease activity to cleave the nucleic acid. The non-specific nuclease function of CRISPR PLUS™ is activated specifically in cancer cell that contain a complementary target sequence of gRNA in the genome. Non-specific nuclease activity in cancer cells destroy cellular double stranded and single stranded DNA/RNA molecules, resulting in the induction of cell death.

Figure 3:
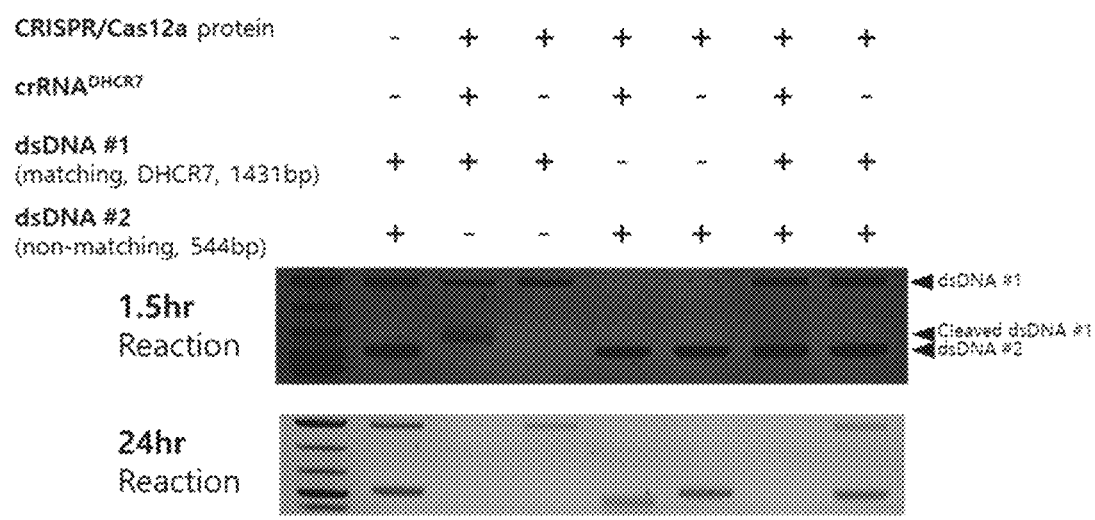
FIG. 3 depicts in vitro nuclease activity assay results.

At FIG. 3, the results of an in vitro cleavage assay are shown. A CRISPR/Cas12a ribonucleoprotein complex is assembled around a guide crRNA targeting human DHCR7. crRNA targets the dsDNA #1, comprising DHCR7, whereas it does not target the dsDNA #2, a nucleic acid lacking the target sequence. One sees that after 24 hours (second lane from the right), when CRISPR/Cas12a was activated by cutting its target DNA (dsDNA #1), it also collaterally degrades the dsDNA of non-target DNA (dsDNA #2). However, CRISPR/Cas12a complexes not previously activated by binding to a target dsDNA #1 show substantially less nonspecific degradation activity (center lane) as seen by the lack of degradation of dsDNA #2.

Figure 4:
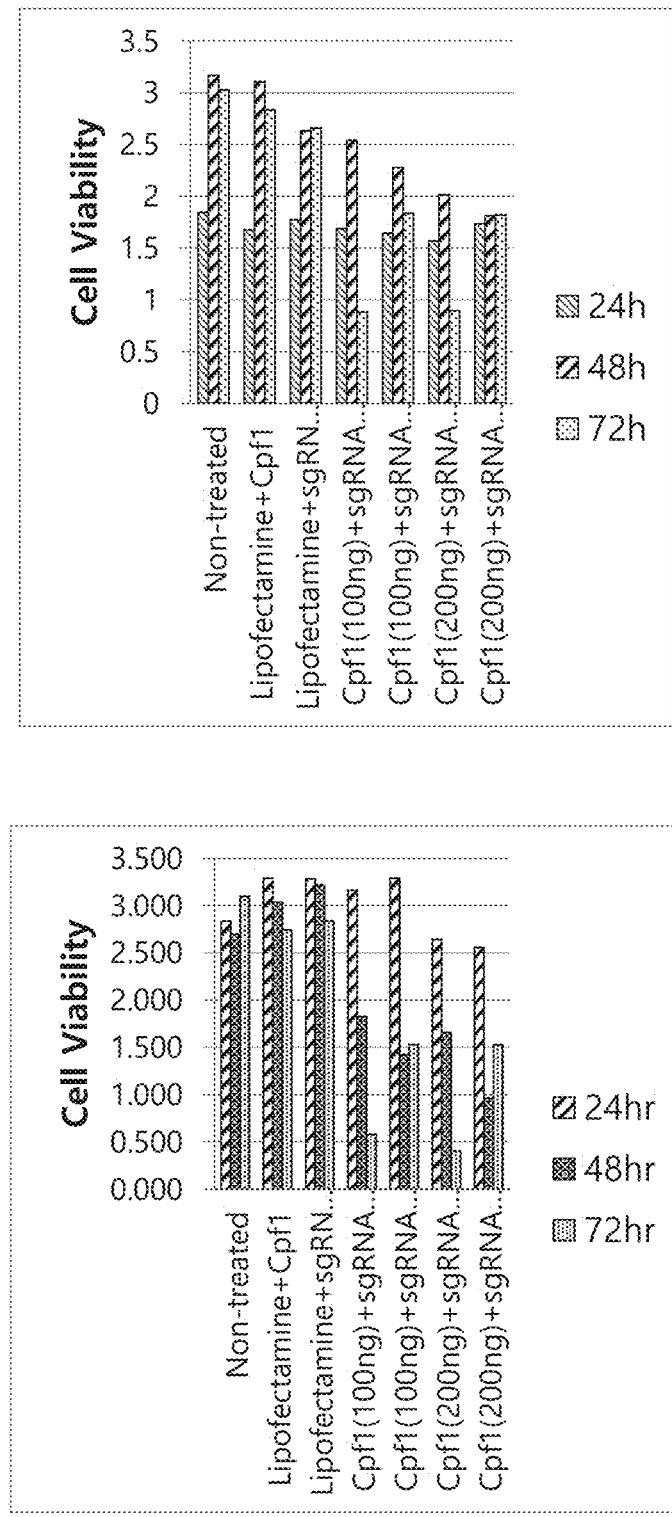
FIG. 4 shows in vivo toxicity assay results.

At FIG. 4, the results of an in vivo cleavage assay of the cytotoxic effect of CRISPR/Cas12a (FnCpf1-BPNLS) on Human cells are shown. At left is a graph showing cell viability on the y-axis, ranging from 0 to 3.5 in increments of 0.5, and treatment groups on the x-axis, including (from left to right) non-treated, Lipofectamine+Cpf1, Lipofectamine+sgRNA, Cpf1(100 ng)+sgRNA, Cpf1 (100 ng)+sgRNA, Cpf1(200 ng)+sgRNA), and Cpf1(200 ng)+sgRNA). Within each treatment group are three bars, which from left to right show the 24 h time point, the 48 h timepoint, and the 72 h timepoint. At right is a graph showing cell viability on the y-axis, ranging from 0.000 to 3.500 in increments of 0.500, and treatment groups on the x-axis, including (from left to right) on-treated, Lipofectamine+Cpf1, Lipofectamine+sgRNA, Cpf1(100 ng)+sgRNA, Cpf1 (100 ng)+sgRNA, Cpf1(200 ng)+sgRNA), and Cpf1(200 ng)+sgRNA). Within each treatment group are three bars, which from left to right show the 24 h time point, the 48 h timepoint, and the 72 h timepoint.

Figure 5:
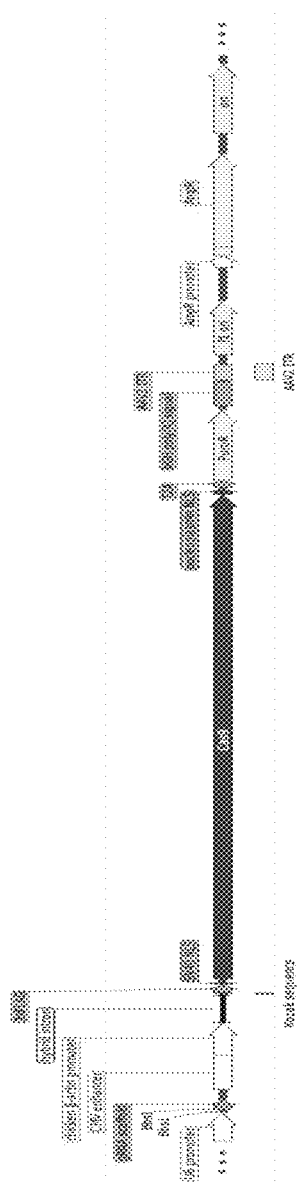
FIG. 5 shows a PX459 plasmid vector system for SpCas9 and sgRNA transfection with puromycin resistance. The PX459 plasmid vector map is from https://www.addgene.org/62988/. SpCas9 and sgRNA is expressed after cleavage of BbsI enzyme and following insertion of target sequence dsDNA oligo.

FIG. 5 shows a PX459 plasmid vector system for SpCas9 and sgRNA transfection with puromycin resistance. Shown from left to right are the U6 promoter, BbsI, BbsI, gRNA scaffold, CMV enhancer, chicken β-actin promoter, hybrid intron, 3×FLAG, SV40 NLS, Kozak sequence, Cas9, nucleoplasmin NLS, T2A, PuroR, bGH poly(A) signal, AAV2 ITR, f1 ori, AmpR promoter, AmpR, and ori.

Figure 6A:
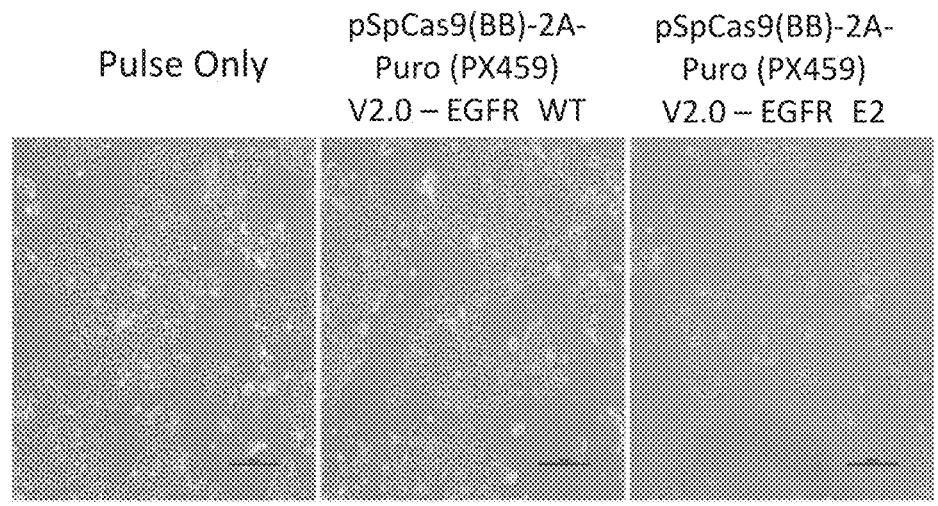
FIGS. 6A-6B show Cas9 guide RNA derived multi-cleavage induction and cell death in an EGFR mutant lung cancer cell line, HCC827, six days after neon electroporation of PX459 plasmid DNA targeting copy number variation.

FIG. 6A has a series of three images showing cells. From left to right, above each image, is a description of the treatment group, which respectively are pulse only, pSpCas9(BB)-2A-Puro (PX459) V2.0-EGFR_WT, and pSpCas9(BB)-2A-Puro (PX459) V2.0-EGFR_E2. The left most image with the pulse only group has many cells, indicating more live cells overall as compared to the right most image. The middle image with the pSpCas9(BB)-2A-Puro (PX459) V2.0-EGFR_WT group also has more live cells as compared to the right most image. The right image with the experimental group, pSpCas9(BB)-2A-Puro (PX459) V2.0-EGFR_E2, comprises less cells compared to the left and middle images, indicating more cell death.

Figure 6B:
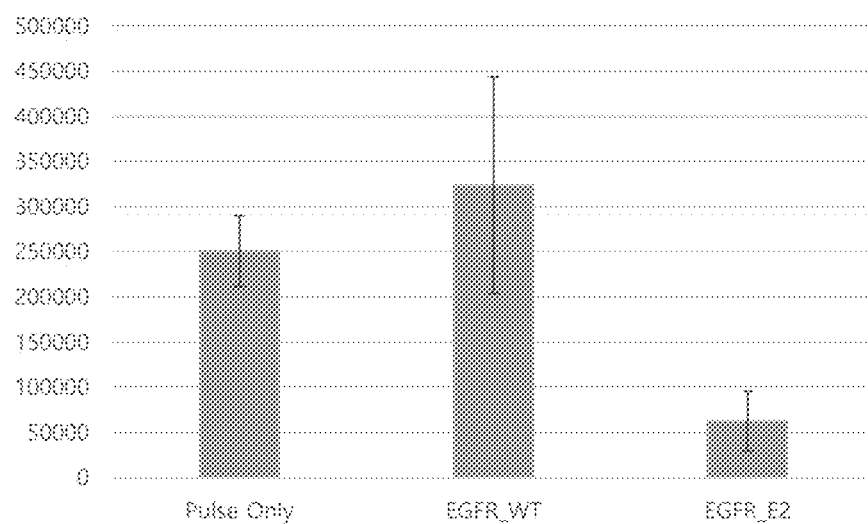

FIG. 6B shows a graph, titled HCC827 cell number comparison (6dpt) with the x-axis showing the three treatments including, from left to right, pulse only, EGFR_WT, and EGFR_E2. The y-axis shows the number of cells, ranging from 0 to 500000 in increments of 50000. Each treatment group additionally indicates error via error bars.

Figure 7:
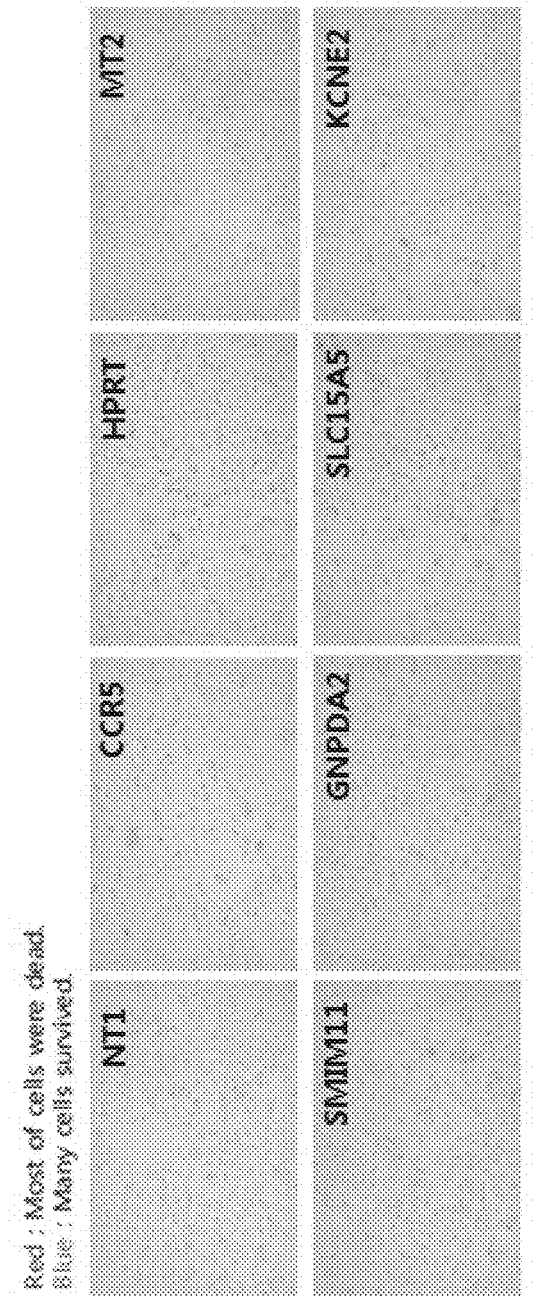
FIG. 7 shows microscopic data confirming cell morphology for each sample in FIG. 8. In treatments targeting the NT1, CCR5, and HPRT1 loci, many cells survived. In treatments targeting the MT2, SMIM11, GNPDA2, SLC15A5, and KCNE2 loci, most cells were dead.

FIG. 7 shows two rows of microscope images of cells. The top left 3 images of the panel show many cells that have survived and are, from left to right, NT1, CCR5, and HPRT1. The top right image and all bottom images in the panel show images wherein most of the cells were found to be dead. The top right image shows the MT2 sample. The bottom row of the panel shows, from left to right, SMIM11, GNPDA2, SLC15A5, and KCNE2.

Figure 8:
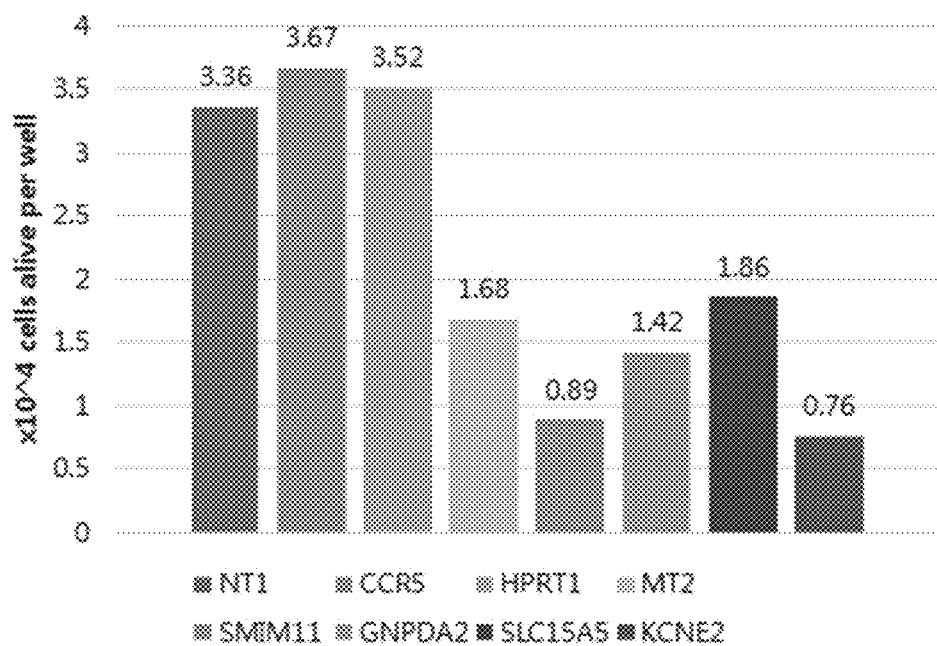
FIG. 8 shows a graph of cell viability in each treatment group, including treatments targeting NT1, CCR5, HPRT1, MT2, SMIM11, GNPDA2, SLC15A5, and KCNE2 loci.

FIG. 8 shows a graph, which on the x-axis from left to right shows the different treatment groups comprising plasmids targeting gene loci. The groups from left to right are NT1, CCR5, HPRT1, MT2, SMIM11, GNPDA2, SLC15A5, and KCNE2. The y-axis shows the number of cells×$10^4$ alive per well and ranges from 0 to 4 in increments of 0.5. Above each bar is the exact number of cells×$10^4$ alive per well and are, from left to right, 3.36, 3.67, 3.52, 1.68, 0.89, 1.42, 1.86, and 0.76.

Figure 9:
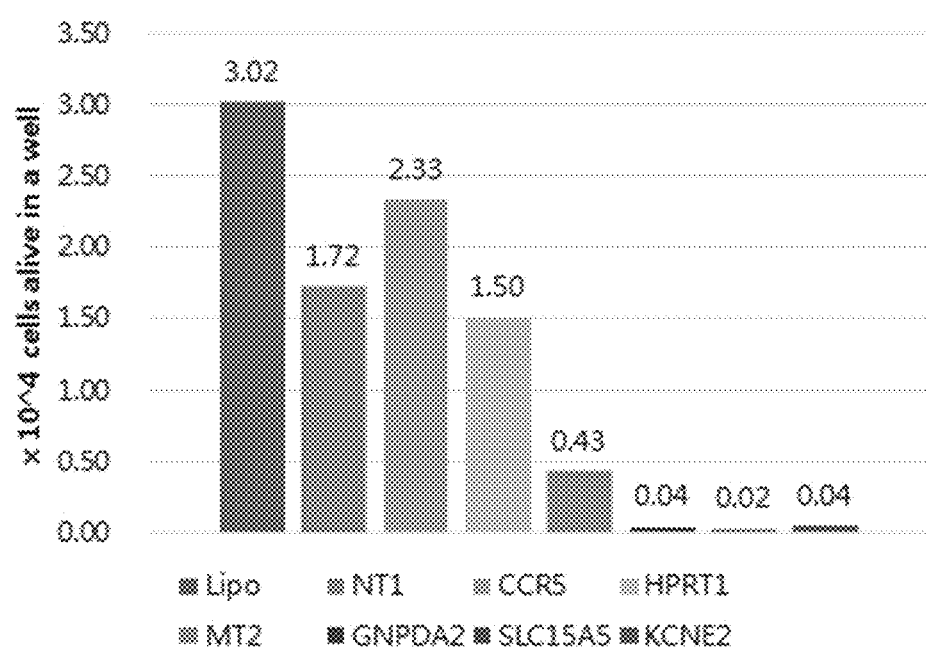
FIG. 9 shows data of cell viability after transfection of CRISPR/Cas9 constructs targeting different gene loci including lipo (lipofectamine only), NT1, CCR5, HPRT1, MT2, GNPDA2, SLC15A5, and KCNE2.

FIG. 9 shows a bar graph, which on the x-axis from left to right, shows the different treatment groups. These groups, from left to right, are Lipo, NT1, CCR5, HPRT1, MT2, GNPDA2, SLC15A5, and KCNE2. The y-axis shows the number of cells×$10^4$ alive per well and ranges from 0.00 to 3.50 in increments of 0.50. Above each bar is the exact number of cells×$10^4$ alive per well and are, from left to right, 3.02, 1.72, 2.33, 1.50, 0.43, 0.04, 0.02, and 0.04.

Figure 10:
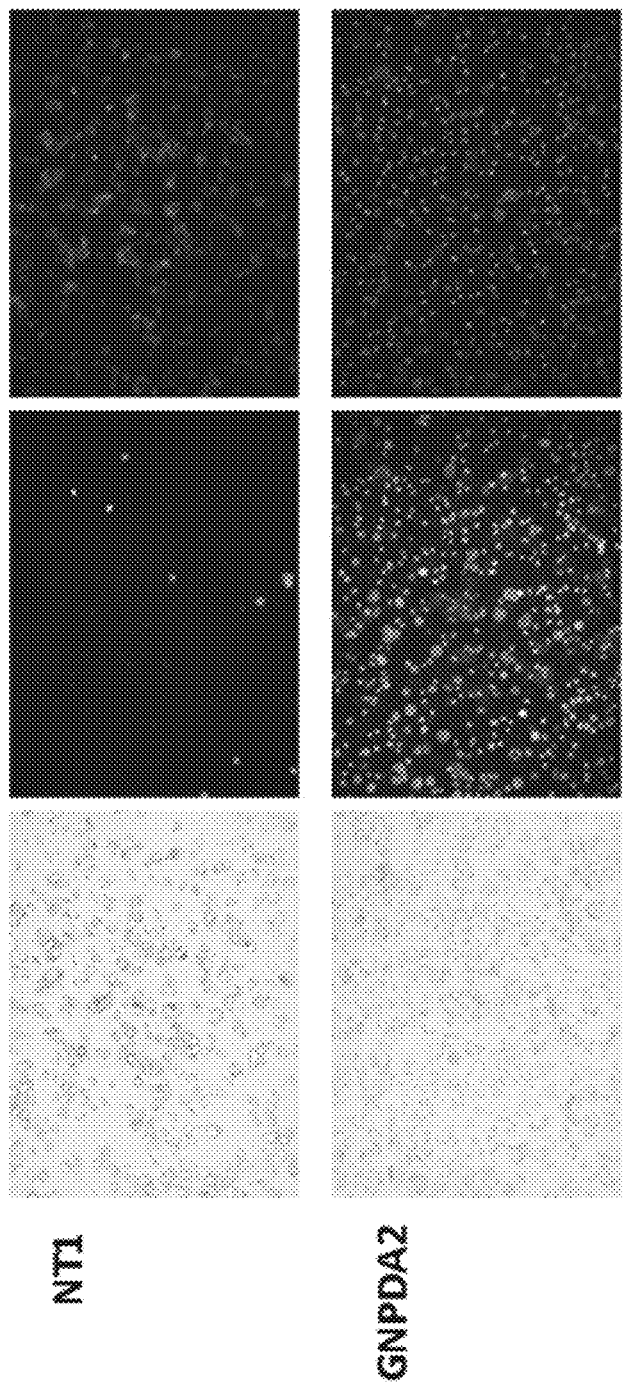
FIG. 10 shows a bright field image and fluorescence microscopy images of CRISPR/Cas9 constructs targeting NT1 (negative control, no matched sequence in the human genome) and GNPDA2.

FIG. 10 shows on the top row, the NT1 sample, which from left to right show, a bright field image, a propidium iodide dead cell stain with a few red spots, and a NucBlue live cell stain reagent with many blue spots. The bottom row shows the GNPDA2 sample, which from left to right show, a bright field image, a propidium iodide dead cell stain with many red spots, and a NucBlue live cell stain reagent with many blue spots.

Figure 11:
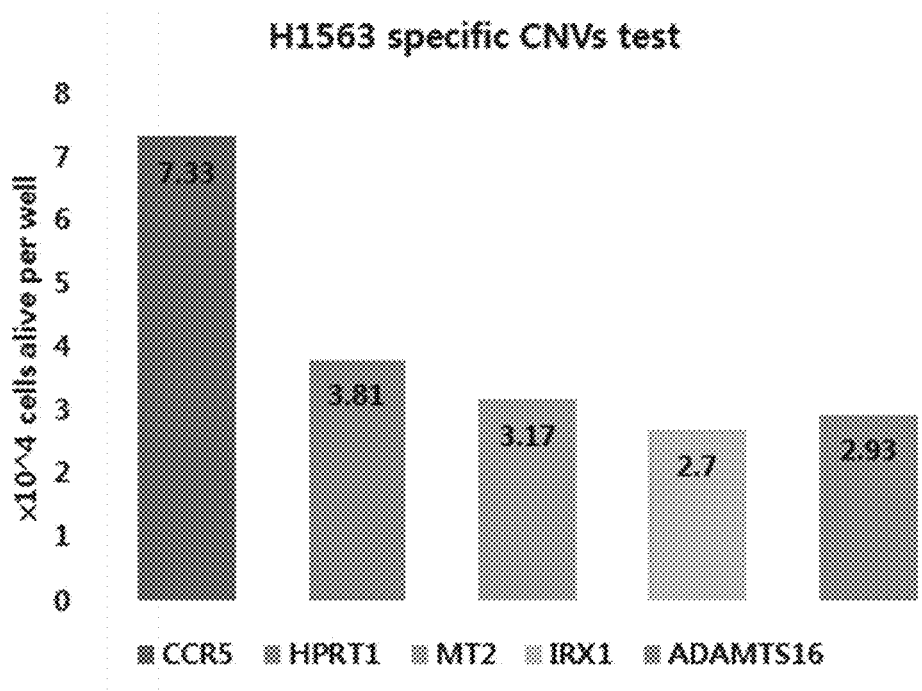
FIG. 11 shows data of cell viability after transfection of CRISPR/Cas9 constructs targeting different gene loci including CCR5, HPRT1, MT2, IRX1, and ADAMTS16.

FIG. 11 shows a bar graph, which on the x-axis from left to right, shows the different treatment groups. These groups are, from left to right, CCR5, HPRT1, MT2, IRX1, and ADAMTS16. The y-axis shows the number of cells×$10^4$ alive per well and ranges from 0 to 8 in increments of 1. At the top of each bar is the exact number of cells×$10^4$ alive per well and are, from left to right, 7.33, 3.81, 3.17, 2.7, and 2.93. The title of the graph, shown at the top, is H1563 specific CNVs test.

Figure 12A:
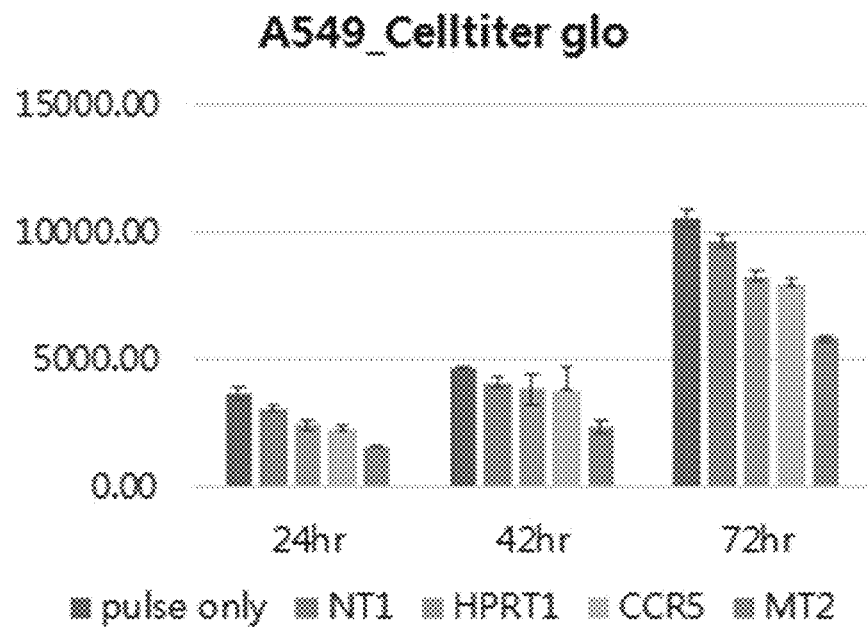
FIGS. 12A-12B show data of cell viability after transfection of CRISPR/Cas9 constructs targeting different gene loci.
Figure 12B:
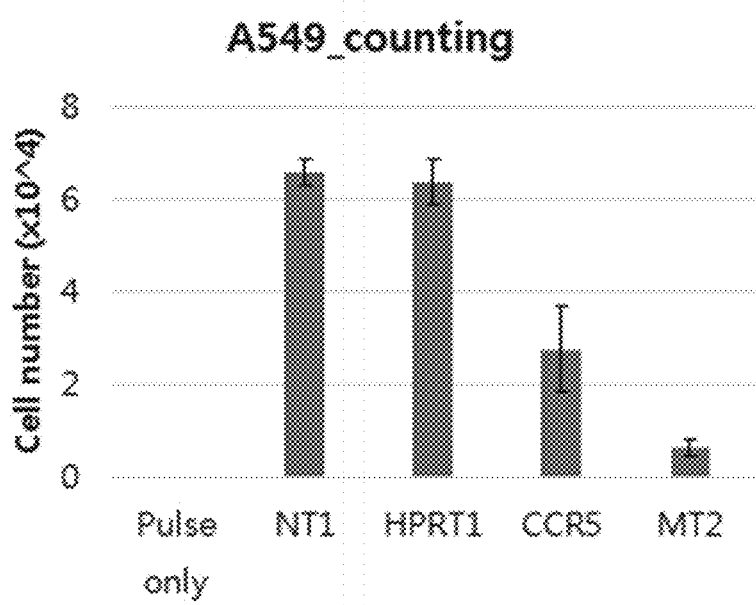

FIG. 12A shows a bar graph, which on the x-axis, from left to right, shows the different time points tested and are 24 hr, 42 hr, and 72 hr. Within each timepoint, five groups were tested shown as 5 bars, which from left to right are pulse only, NT1, HPRT1-1, CCR5, and MT2. The y-axis shows a scale bar from 0.00 to 15000.00 in increments of 5000.00. The title of the graph, shown at the top, is A549_Celltiter glo FIG. 12B shows a bar graph titled A549_counting. The x-axis, from left to right, shows the different treatment groups of pulse only, NT1, HPRT1, CCR5, and MT2. The y-axis shows the cell number (×$10^4$) and ranges from 0 to 8 in increments of 2.

Figure 13:
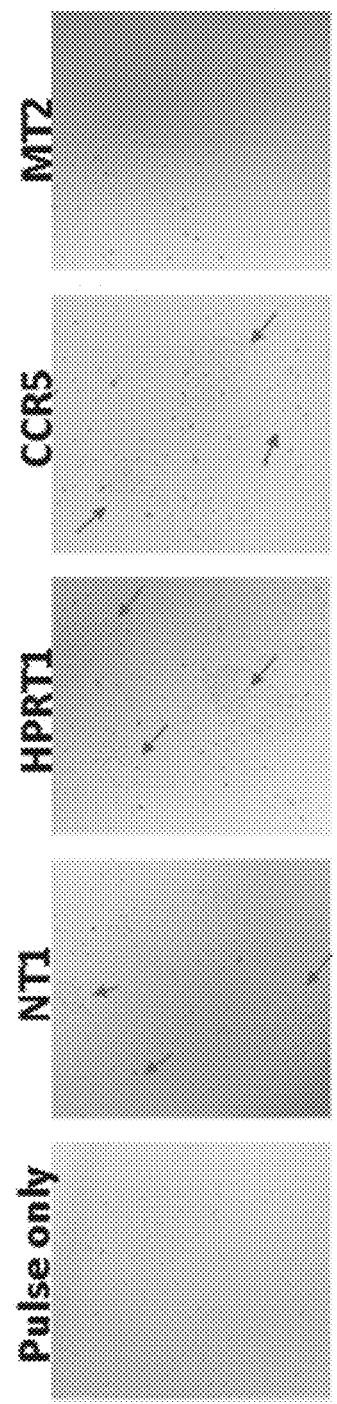
FIG. 13 shows bright field images of cells after transfection of CRISPR/Cas9 constructs targeting different gene loci including pulse only, NT1, HPRT1, CCR5, and MT2, with arrows point to live cell colonies.

FIG. 13 shows microscope images showing cells after different treatments, which from left to right are pulse only, NT1, HPRT1, CCR5, and MT2. The NT1, HPRT1, and CCR5 images include arrows point to live cells.

Figure 14:
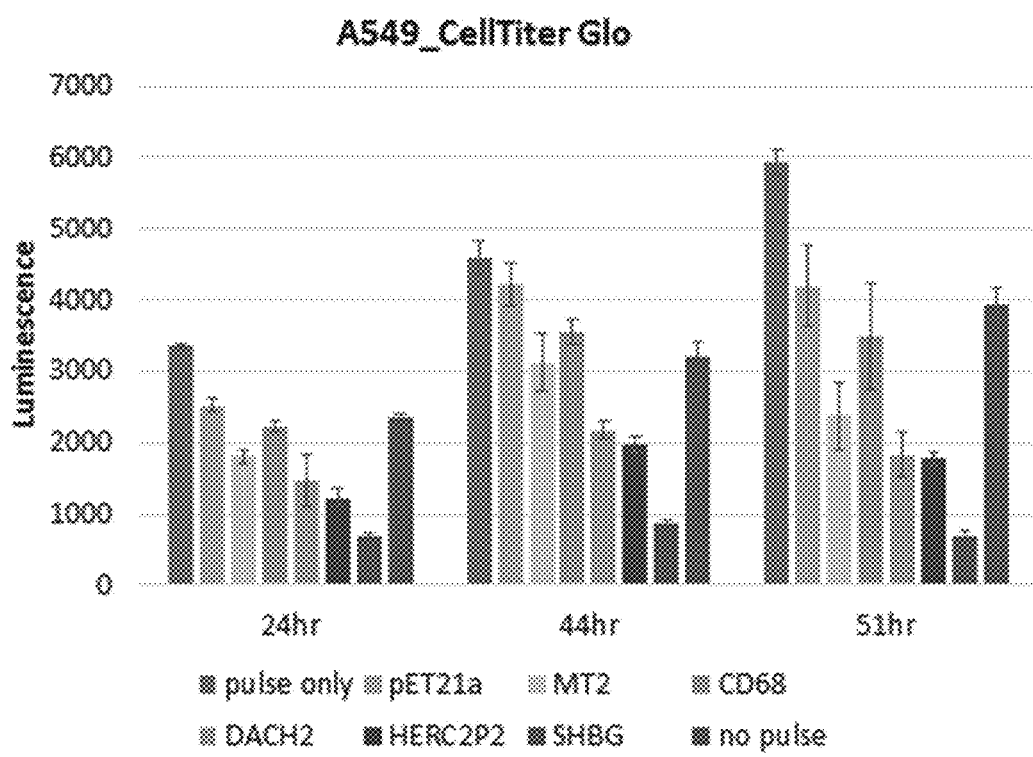
FIG. 14 shows data of cell viability after transfection of cells with CRISPR/Cas9 constructs targeting different gene loci including pulse only, pET21a, MT2, CD68, DACH2, HERC2P2, SHBG, and no pulse at 24 hr, 44 hr, and 51 hr post-electroporation.

FIG. 14 shows a bar graph titled A549 CellTiter Glo depicting a first trial, which on the x-axis, from left to right, shows the different time points tested and are 24 hr, 44 hr, and 51 hr. Within each timepoint, different groups were tested shown as bars, which from left to right are pulse only, pET21a, MT2, CD68, DACH2, HERC2P2, SHBG, and no pulse. The y-axis shows luminescence ranging from 0 to 7000 in increments of 1000.

Figure 15A:
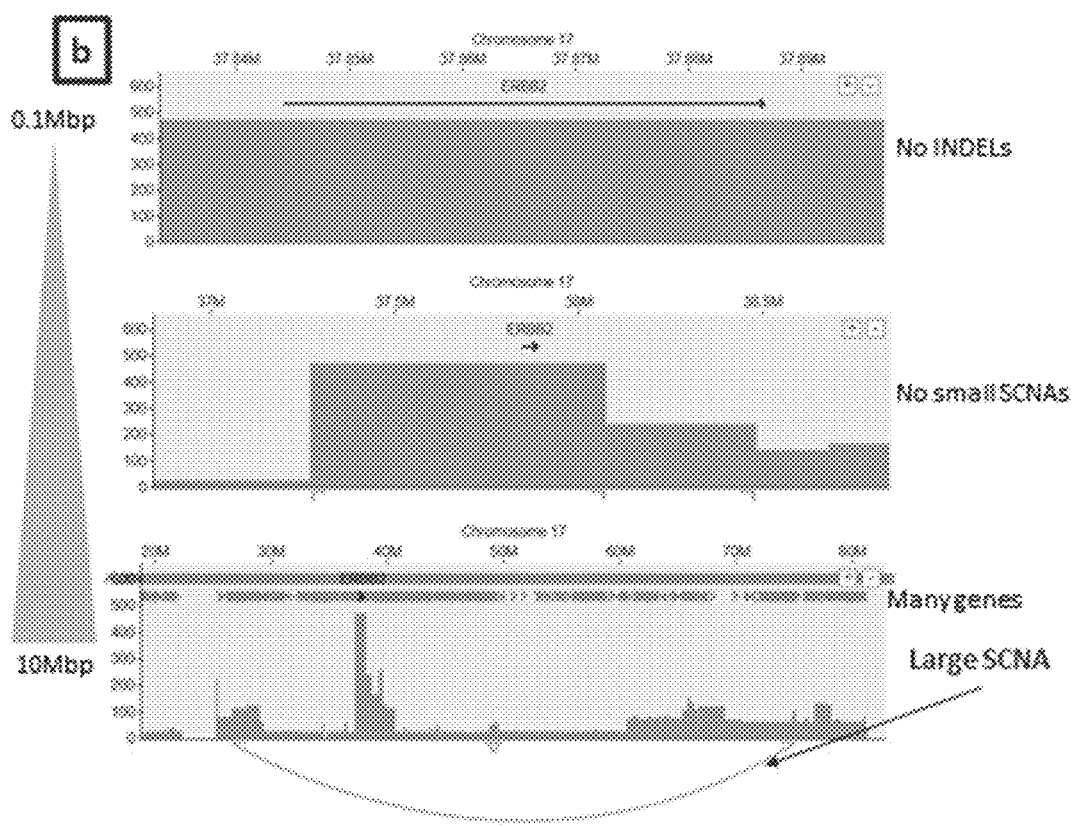
FIGS. 15A-15C show the duplicated region of ERBB2 in SK-BR-3 with whole genome sequence data.

FIG. 15A shows three graphs of the SK-BR-3 ERBB2 region whole genome sequence data from Nattestad, M. et al. (Complex rearrangements and oncogene amplifications revealed by long-read DNA and RNA sequencing of a breast cancer cell line. Genome Res. 28, 1126-1135 (2018).). Shown to the left of the three graphs is a scale bar, which at bottom indicates 10 Mbp and which at top indicates 0.1

Mbp. The top most graph shows Chromosome 17 and ERBB2 with no indels and shows the 37.84M to 37.89M region in increments of 0.01M. The middle graph shows the region scaling from 37M to 38.5M in increments of 0.5M and shows no small SCNAs. The bottom graph shows the region scaling from 20M to 80M in increments of 10M and shows many genes. An arrow indicates large SCNA. The y-axis on all three graphs ranges from 0 to 600 in increments of 100.

Figures 15B, 15C:
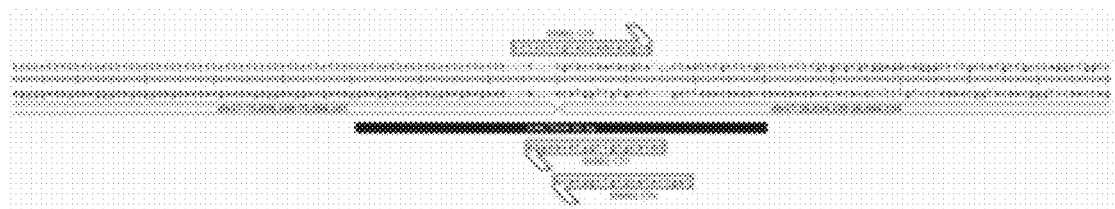

FIG. 15B shows a table, which from left to right shows chrom1, pos1, strand1, chrom2, post2, and strand2. Under chrom1 is 17, variant_name, and 22790. Under post is 26654135, variant_type, and DUP, under strand1 is "−", split, and 37, under chrom2 is 17, size and 48414052, under pos2 is 75068187, CNV_category, and matching, and under strand2 is "+", category and solo.

FIG. 15C shows SK-BR-3 ERBB2 CNV junction sequence inferred from Nattestad et al. To the left, under the sequence, is chr17:75,058,188-75,068,187 and immediately to the right is chr17:26,654,135-26,664,134. Spanning these two regions is 60 bp of a junction region. Within the junction region are ERBB2 CT5, ERBB2 CT7, and ERBB2 CT6.

Figure 16A:
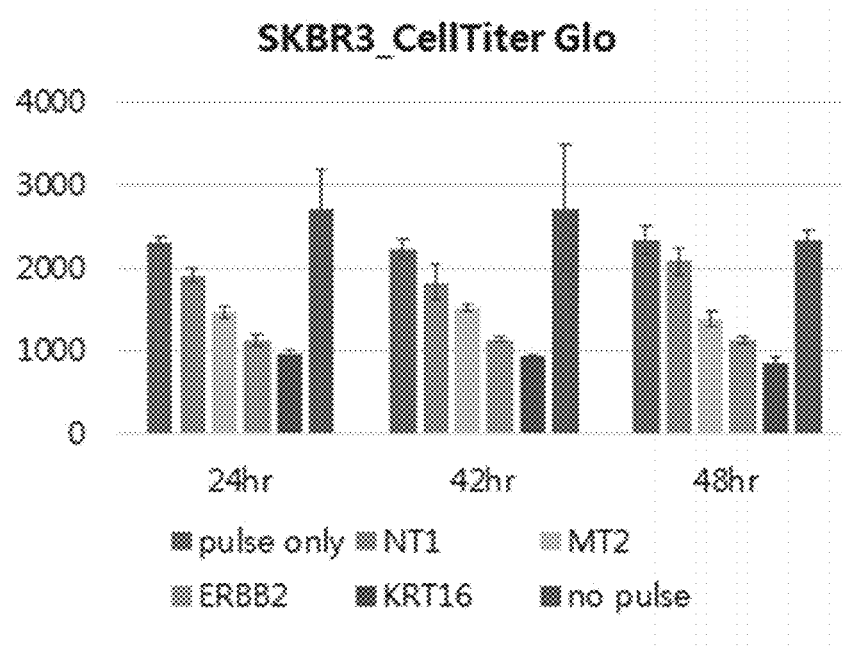
FIGS. 16A-16B show data from electroporation of cells with CRISPR/Cas9 constructs targeting different gene loci.

FIG. 16A shows a bar graph titled SKBR3_CellTiter Glo, which on the x-axis, from left to right, shows the different time points tested and are 24 hr, 42 hr, and 48 hr. Within each timepoint, different groups were tested shown as bars, which from left to right are pulse only, NT1, MT2, ERBB2, KRT16, and no pulse. The axis shows luminescence ranging from 0 to 4000 in increments of 1000.

Figure 16B:
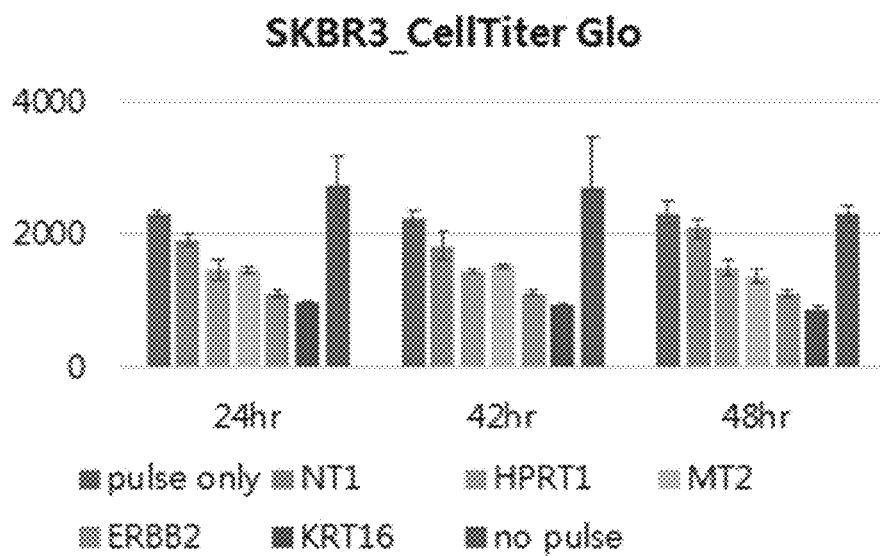

FIG. 16B shows a bar graph, which is the raw data for the the graph in FIG. 16A. The x-axis, from left to right, shows the different time points tested and are 24 hr, 42 hr, and 48 hr. Within each timepoint, different groups were tested shown as bars, which from left to right are pulse only, NT1, HPRT1, MT2, ERBB2, KRT16, and no pulse. The axis shows values ranging from 0 to 4000 in increments of 500.

Figure 17:
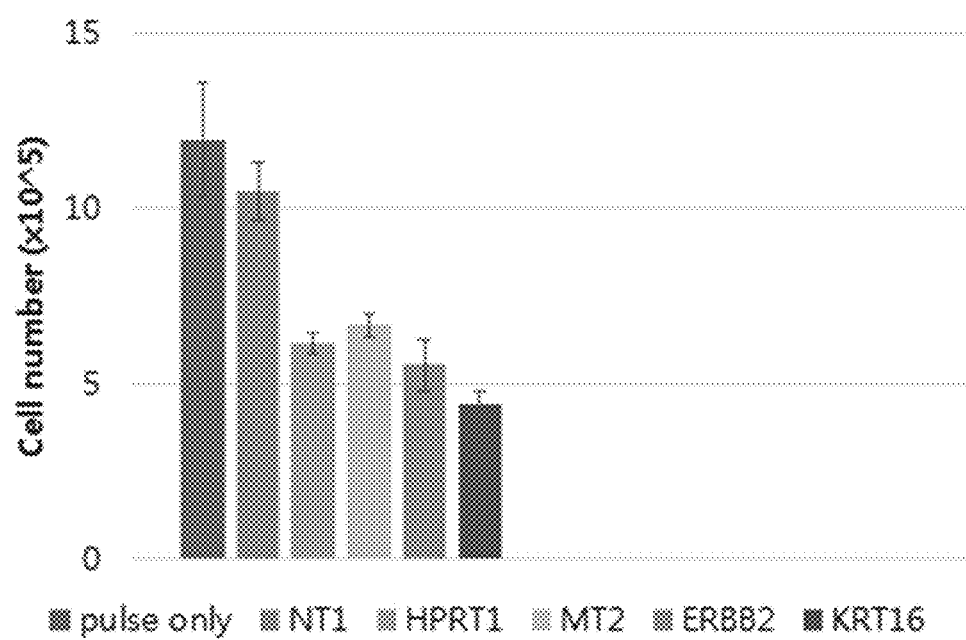
FIG. 17 shows data from electroporation of cells with CRISPR/Cas9 constructs targeting different gene loci. Samples include pulse only, NT1, HPRT1, MT2, ERBB2, and KRT16.

FIG. 17 shows a bar graph, which on the x-axis, from left to right, shows the different groups tested including pulse only, NT1, HPRT1, MT2, ERBB2, and KRT16. The y-axis shows cell number (×10^5) ranging from 0 to 15 in increments of 5.

Figure 18A:
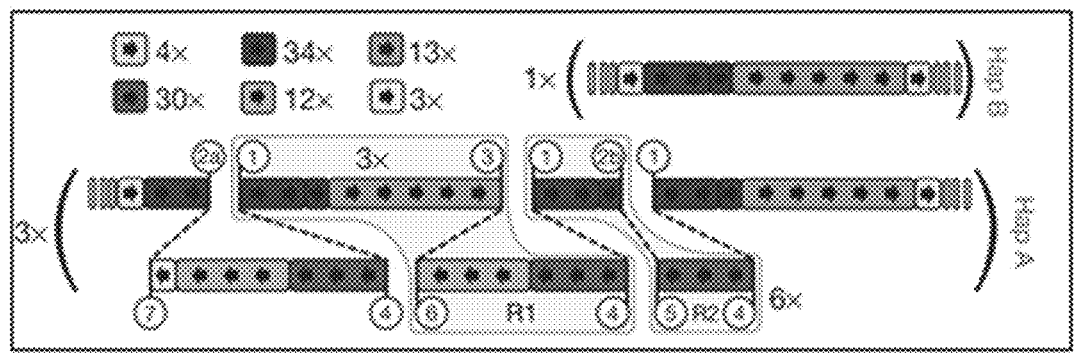
FIGS. 18A-18C show HeLa duplicated sequences.

FIG. 18A shows HPV and HeLa cell integration data from Adey et al. Purple is HeLa (shown in the HepB panel and shown at top in the HepA panel) and green is HPV (shown at bottom in the HepA panel). The strength of the signal is shown by the color of the shading. The key at the top left shows the legend, which shows purple shading on the top row and green shading on the bottom row. The top row of the legend shows from left to right, 4×, 34×, and 13×. The bottom row of the legend shows, from left to right, 30×, 12×, and 3×.

Figure 18B:
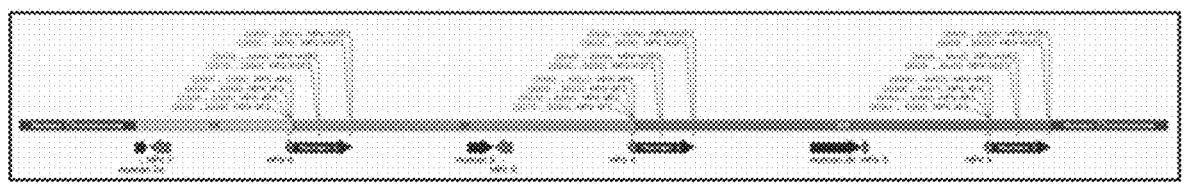

FIG. 18B shows HPV sequence data in HeLa cell inferred from Meissner et al, Landry et al, Adey et al., and Liu et al. Shown in the diagram is the human chromosome. From left to right, the following regions are shown: 1×, 3×, and 6×. Repeat numbers are marked as X and only opened sequences are marked as arrow. The text below the diagram shows annotations of specific regions, which, from left to right, are Human 2a, HPV7, HPV4, Human 1, Human 3, HPV 6, HPV4, and Human 1.

Figure 18C:
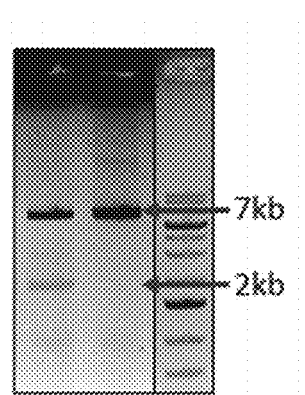

FIG. 18C shows a gel of the PCR product of the repeat region between HPV sequences in HeLa cells, based on the references noted above in FIG. 18B, which shows a ladder in the right most lane. Arrows point to 7 kb and 2 kb.

Figure 19A:
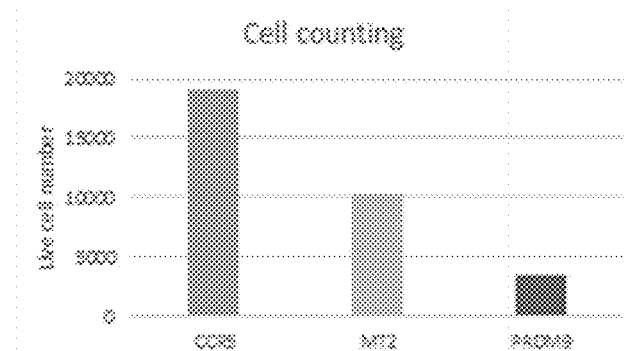
FIGS. 19A-19B show HeLa cell death after targeting HeLa CNV or HPV gene.

FIG. 19A shows a graph titled cell counting, which on the x-axis, from left to right, shows different groups tested including CCR5, MT2, and PRDM9. The y-axis shows live cell number ranging from 0 to 20000 in increments of 2000.

Figure 19B:
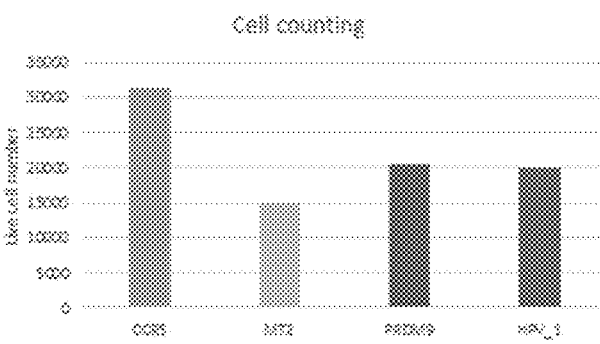

FIG. 19B shows a graph titled cell counting, which on the x-axis, from left to right, shows different groups tested including CCR5, MT2, PRDM9, and HPV_1. The y-axis shows live cell number ranging from 0 to 35000 in increments of 5000.

Figure 20A:
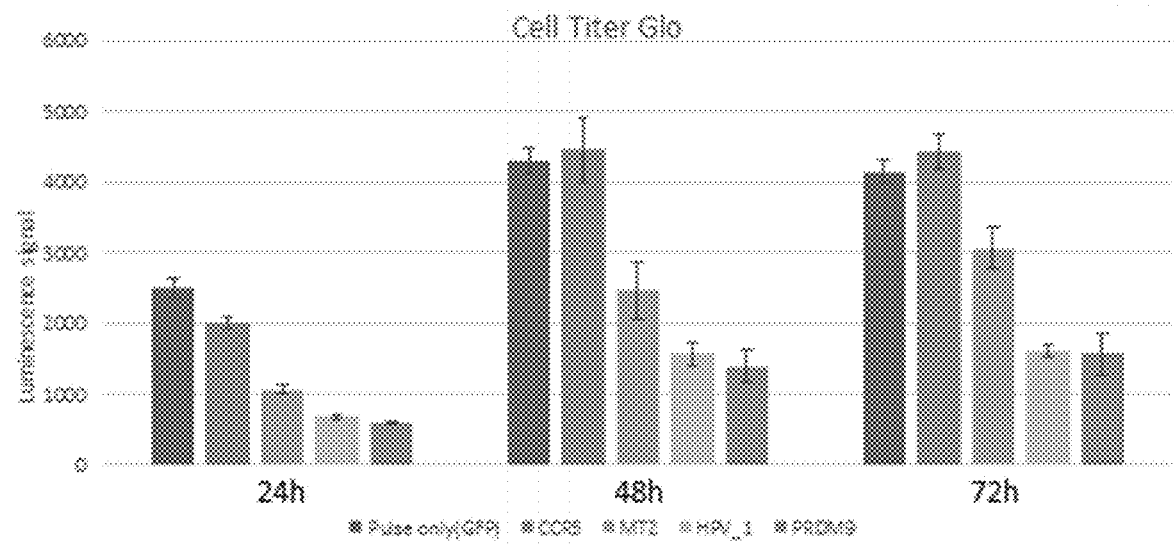
FIGS. 20A-20B show HeLa cell death after targeting HeLa CNV or HPV gene.

FIG. 20A shows a graph titled Cell Titer Glo and shows on the x-axis, from left to right, different timepoints that were tested including 24 h, 48 h, and 72 h. Within each timepoint, different groups were tested, which from left to right are pulse only (GFP), CCR5, MT2, HPV_1, and PRDM9. The y-axis shows luminescence signal ranging from 0 to 6000 in increments of 1000.

Figure 20B:
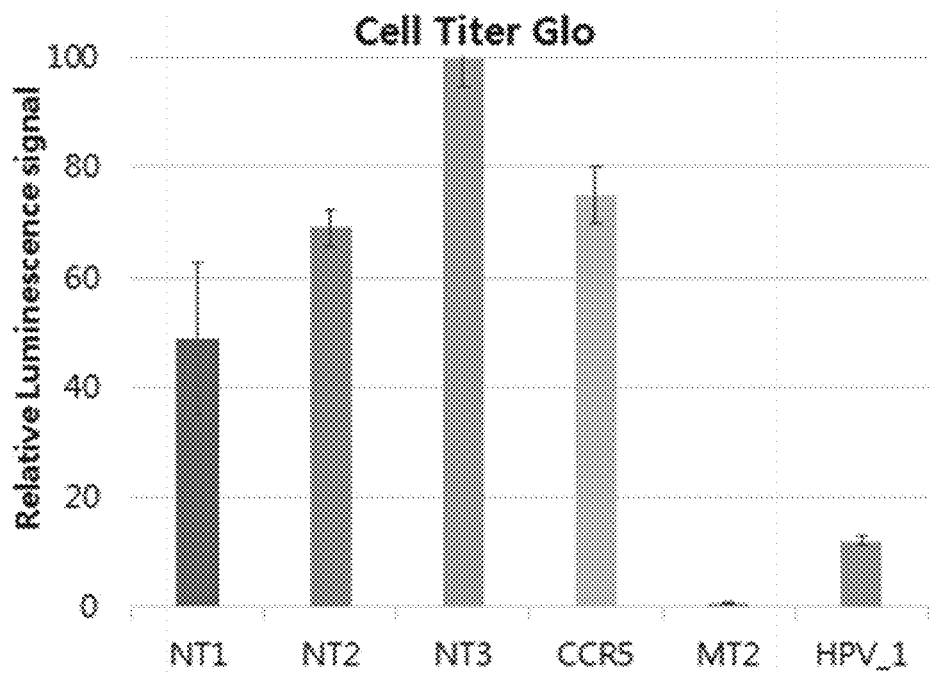

FIG. 20B shows a graph titled Cell Titer Glo. The y-axis shows the relative luminescence signal, ranging from 0 to 100 in increments of 20, and the x-axis shows the different groups tested, which are (from left to right) NT1, NT2, NT3, CCR5, MT2, and HPV 1.

Figure 21:
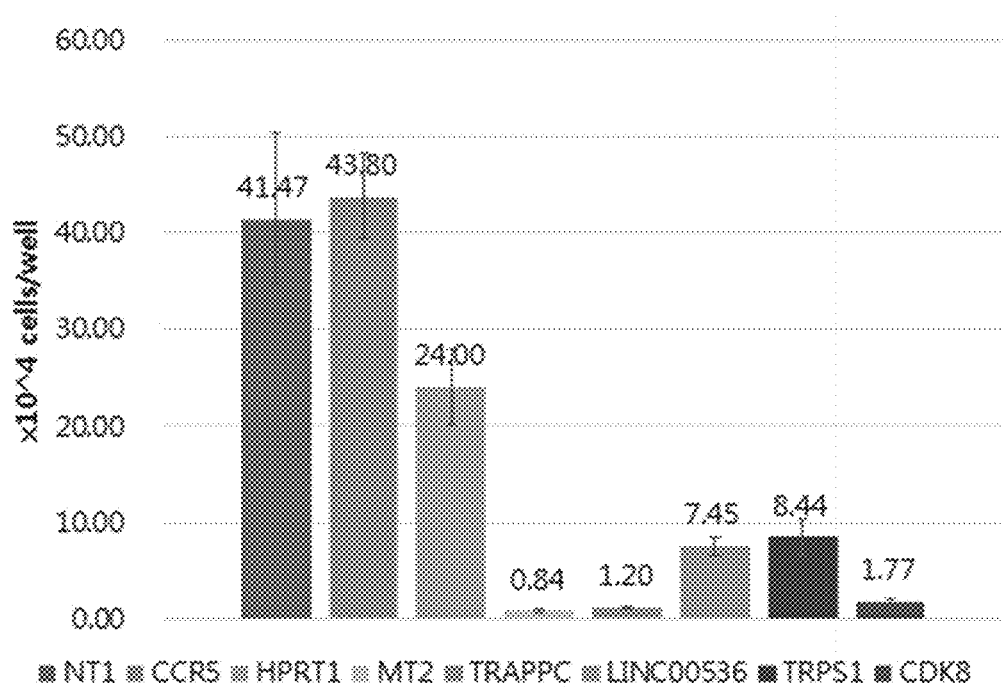
FIG. 21 shows cell viability after transfection of HT29 cells with CRIPSR/Cas9 targeting various gene loci. Samples include NT1, CCR5, HPRT1, MT2, TRAPPC, LINC00536, TRPS1, and CDK8.

FIG. 21 shows a graph, which shows different groups tested on the x-axis. Shown on the x-axis, from left to right, are NT1, CCR5, HPRT1, MT2, TRAPPC, LINC00536, TRPS1, and CDK8. The y-axis shows cell number (×10^4 cells/well) ranging from 0.00 to 60.00 in increments of 10.00.

Figure 22:
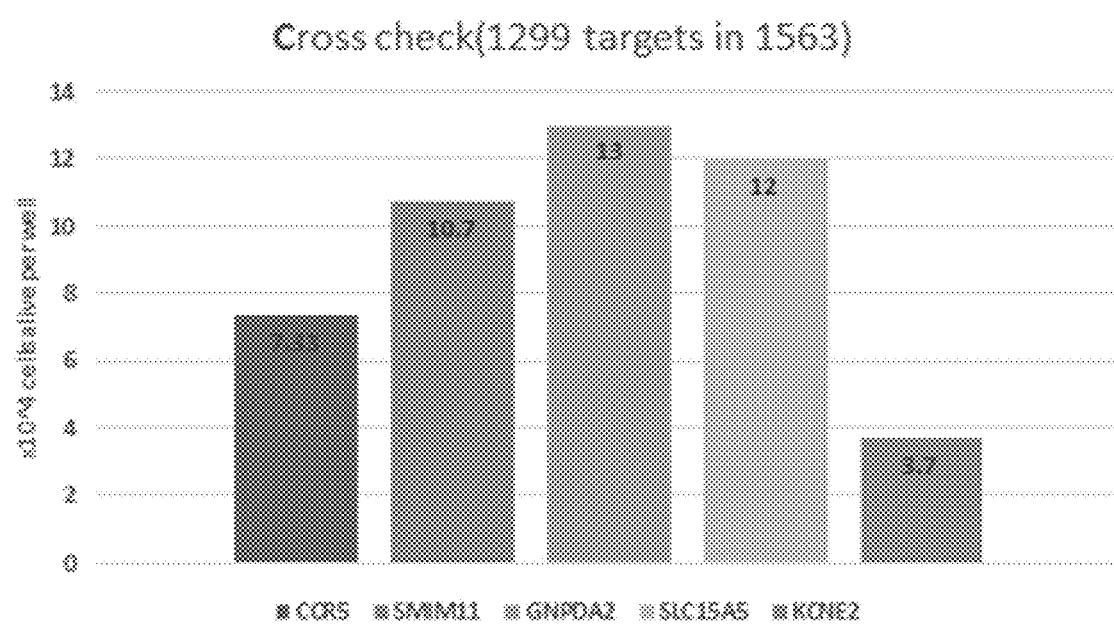
FIG. 22 shows cell viability after transfection of H1563 cells with CRIPSR/Cas9 targeting various gene loci. Samples include CCR5, SMIM11, GNPDA2, SLC15A5, and KCNE2.

FIG. 22 shows a graph titled cross check (1299 targets in 1563). The x-axis shows different groups tested, which from left to right are CCR5, SMIM11, GNPDA2, SLC15A5, and KCNE2. The y-axis shows the number of cells (×10^4 cells alive per well) ranging from 0 to 14 in increments of 2. In the bar displayed for each group is the exact number of cells (×10^4) alive per well, which from left to right are 7.33, 10.7, 13, 12, and 3.7.

Figure 23:
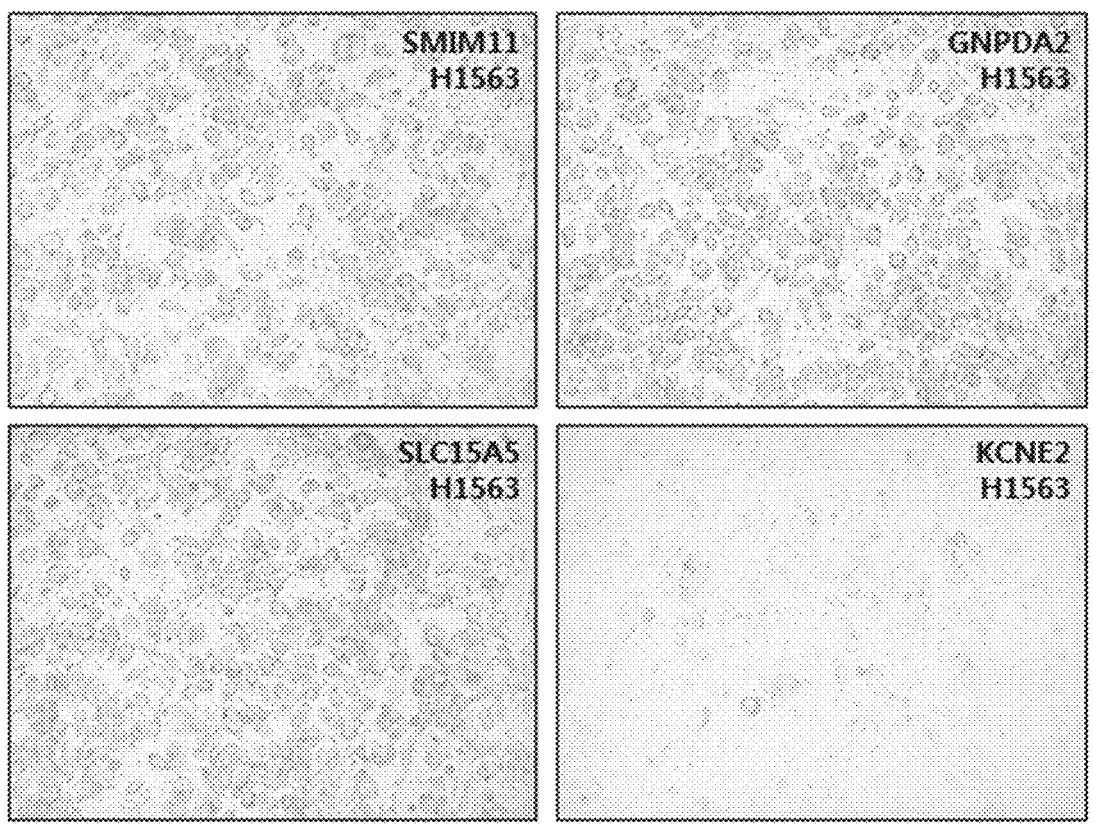
FIG. 23 shows microscopic images of cell viability after transfection of cells with CRIPSR/Cas9 targeting various gene loci.

FIG. 23 shows microscope images of cells. The top row shows, from left to right, SMIM11 H1563 and GNPDA2 H1563. The bottom right shows, from left to right, SLC15A5 H1563 and KCNE2 H1563.

Figure 24:
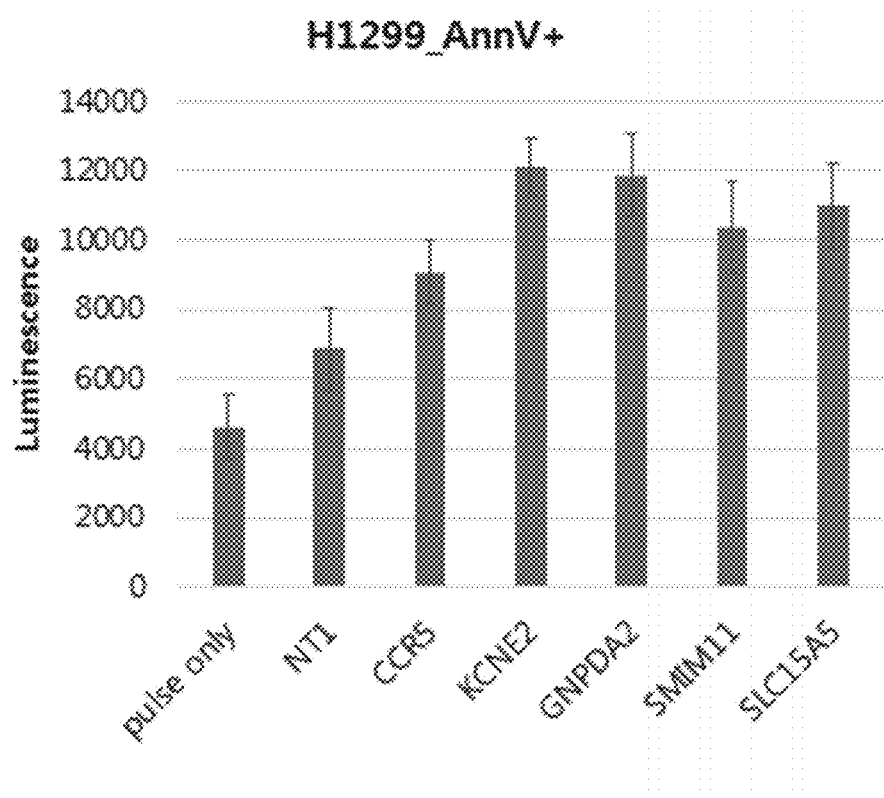
FIG. 24 shows cell viability via AnnexinV quantification after transfection of cells with CRIPSR/Cas9 targeting various gene loci.

FIG. 24 shows a graph, which on the x-axis shows, from left to right, pulse only, NT1, CCR5, KCNE2, GNPDA2, SMIM11, and SLC15A5. The y-axis shows luminescence ranging from 0 to 14000 in increments of 2000. The graph is titled H1299_AnnV+.

Figure 25:
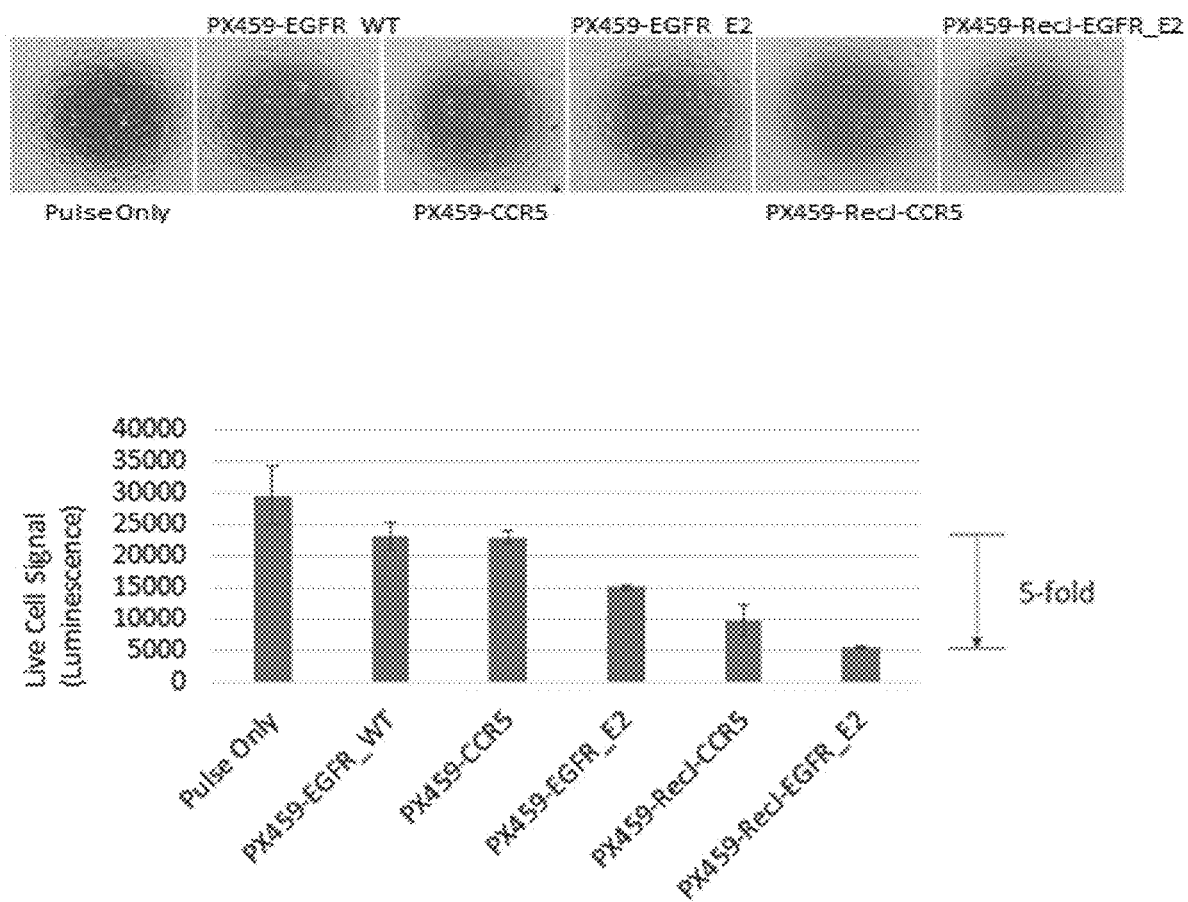
FIG. 25 shows, at top, images of cells after transfection of cells with CRISPR/Cas9 or CRISPR PLUS systems targeting various gene loci. At bottom is a graph of cell viability of each treatment.

FIG. 25 shows at top microscope images, which from left to right, are pulse only, PX459-EGFR_WT, PX459-CCR5, PX459-EGFR_E2, PX459-RecJ-CCR5, and PX459-RecJ-EGFR_E2. At the bottom is a graph, which from left to right, shows pulse only, PX459-EGFR_WT, PX459-CCR5, PX459-EGFR_E2, PX459-RecJ-CCR5, and PX459-RecJ-EGFR_E2. The y-axis shows live cell signal (luminescence) ranging from 0 to 40000 in increments of 5000.

Figure 26:
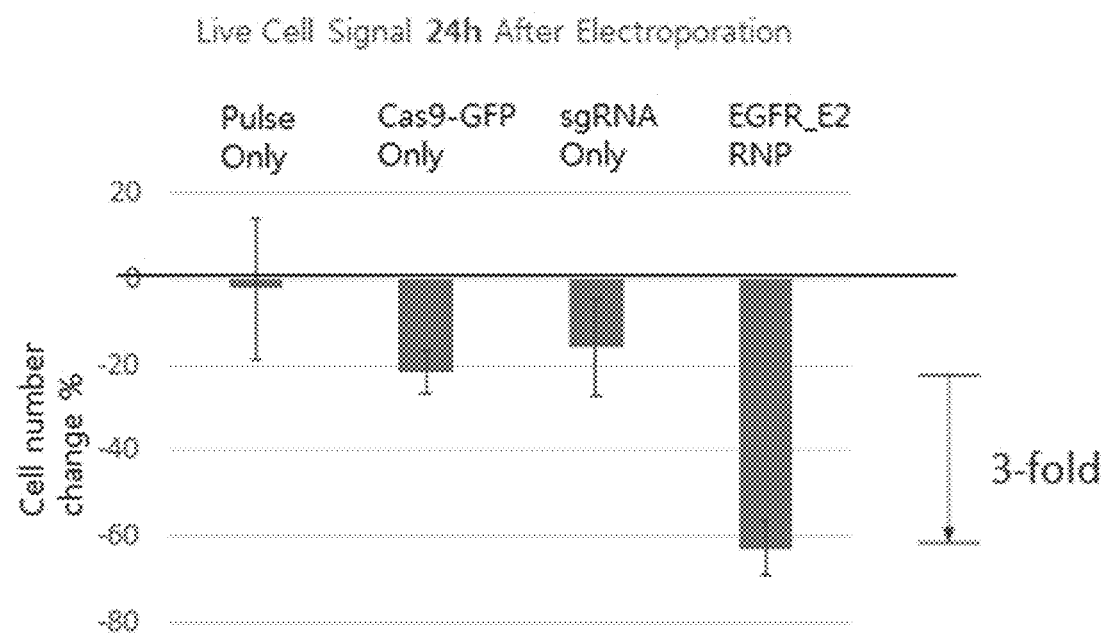
FIG. 26 shows RNP neon electroporation showing Cas9 guide RNA derived multi-cleavage induction and cell death in an EGFR mutant lung cancer cell line, HCC827.

FIG. 26 shows a graph, which on the x-axis shows, from left to right, pulse only, Cas9-GFP only, sgRNA only, and EGFR_E2 RNP. The y-axis shows the cell number change % ranging from −80 to 20 in incrememnts of 20. The title of the graph, shown at the top, is Live cell signal 24 h after electroporation.

Figure 27:
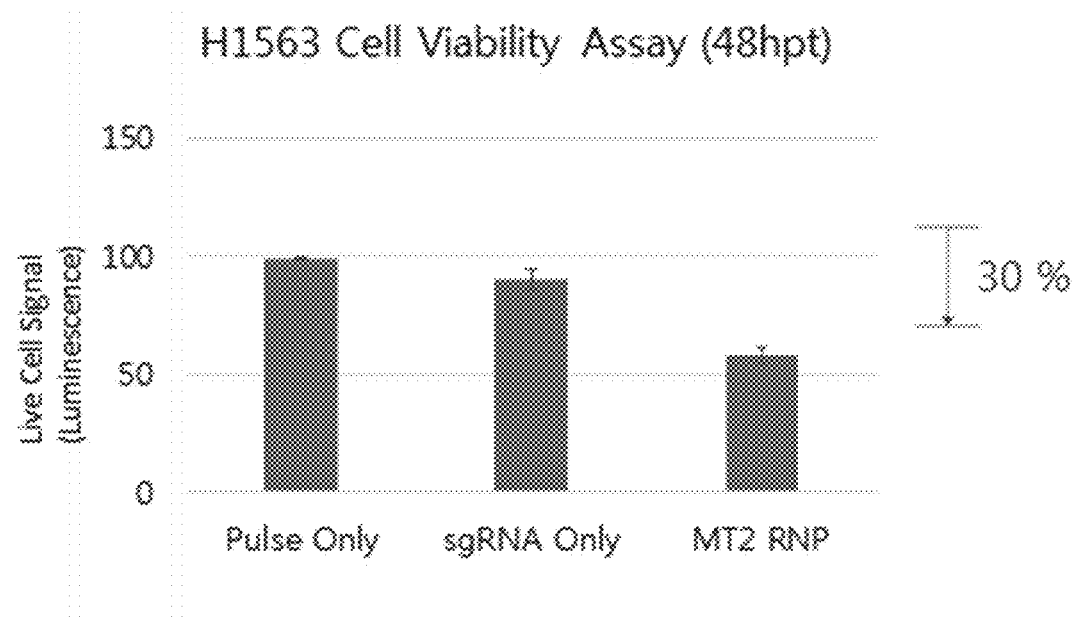
FIG. 27 shows RNP lipofection of CRISPR/Cas9 or CRISPR PLUS systems 2 days after lipofection, wherein the Cas9 guide RNA induces multi-cleavage and cell death in an adenocarcinoma cell line, H1563.

FIG. 27 shows a graph of H1563 cell viability assay at the 48 hr time point. The x-axis, from left to right, shows pulse only, sgRNA only, and MT2 RNP. The y-axis shows the live cell signal (luminescence) ranging from 0 to 150 in increments of 50. The title, shown at the top of the graph, is H1563 cell viability assay (48hpt).

Figure 28:
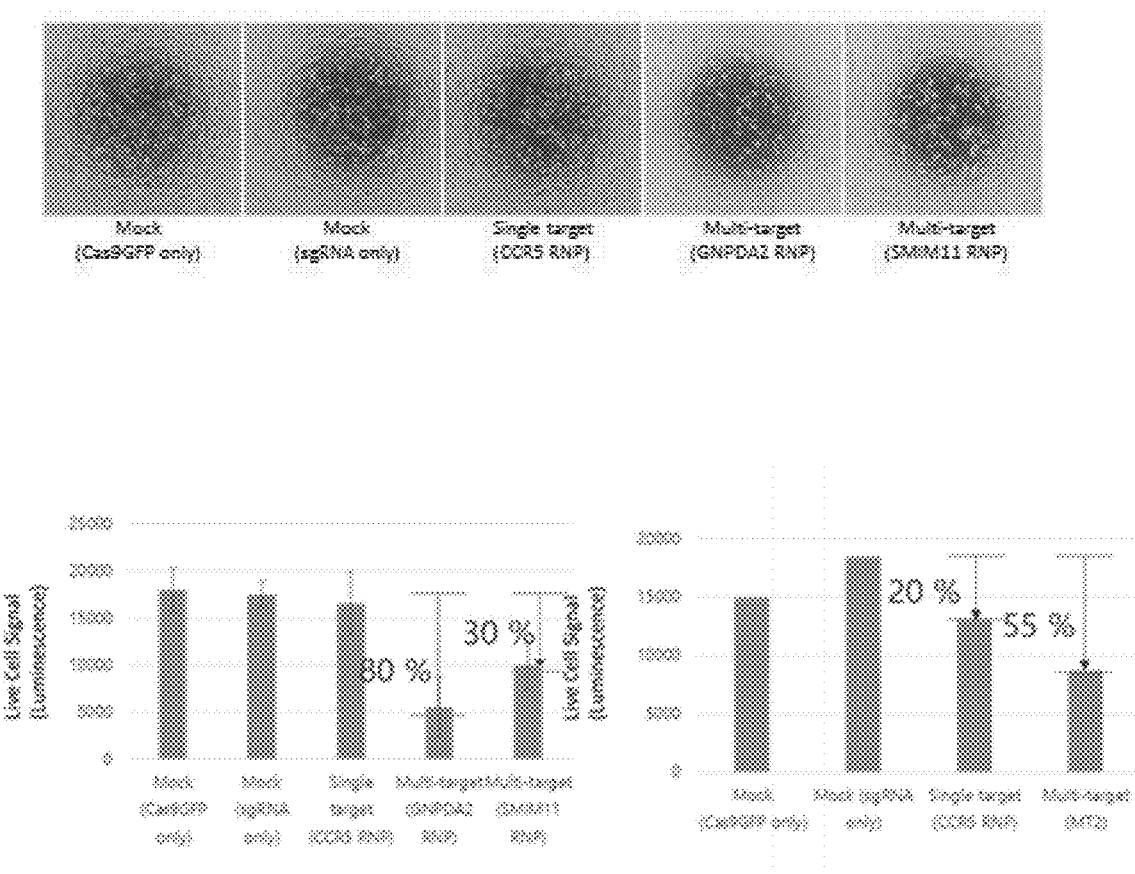
FIG. 28 shows, at top, images of cells after electroporation of cells with CRISPR/Cas9 or CRISPR PLUS systems targeting various gene loci. The bottom graphs show cell viability after electroproation in H1299 cells, an adenocarcinoma cell line.

FIG. 28 at top shows bright field images of cells, which from left to right are mock (Cas9GFP only), Mock (sgRNA only), single target (CCR5 RNP), multi-target (GNPDA2 RNP), and multi-target (SMIM11 RNP). The bottom left is a graph, which from left to right on the x-axis shows mock (Cas9GFP only), Mock (sgRNA only), single target (CCR5 RNP), multi-target (GNPDA2 RNP), and multi-target (SMIM11 RNP) and which on the y-axis shows the live cell signal (luminescence) from 0 to 25000 in increments of 5000. The bottom right is a graph, which from left to right on the x-axis shows mock (Cas9GFP only), Mock (sgRNA only), single target (CCR5 RNP), and multi-target (MT2). The y-axis shows the live cell signal (luminescence) from 0 to 20000 in increments of 5000.

Figure 29:
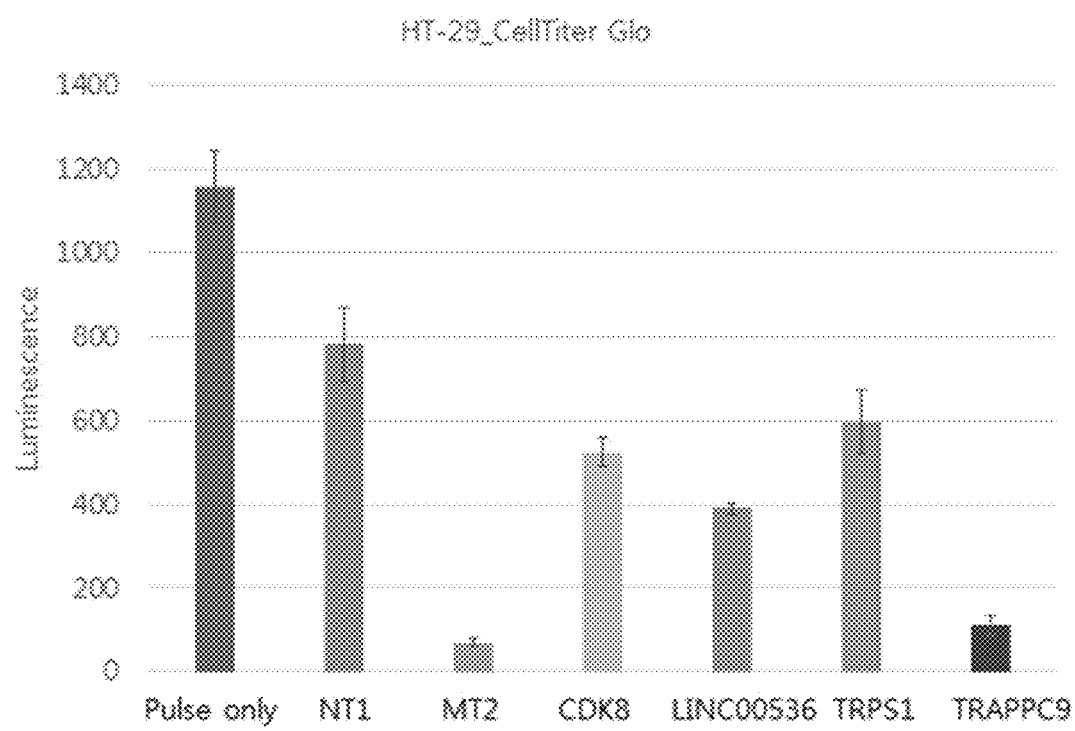
FIG. 29 shows cell viability, as measured by a Cell Titer Glo assay, after targeting CNVs in HT-29 cells.

FIG. 29 shows a bar graph, which shows on the x-axis (from left to right) the treatment groups of pulse only, NT1 (non-target), MT2, CDK8, LINC00536, TRPS1, and TRAPPC9. The y-axis shows luminescence and ranges from 0 to 1400 in increments of 200.

Figure 30:
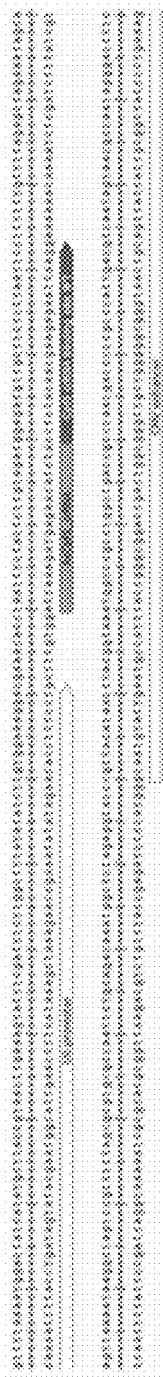
FIG. 30 shows the target sequences for AsCpf1_crRNA and the Cpf1 crRNA binding site WT. Figure discloses SEQ ID NO: 3299.

FIG. 30 shows the target sequence of AsCpf1_crRNA and Cpf 1 crRNA binding site WT. To the left of the target binding region is the end of the U6 promoter region and on the bottom row of sequence is the start of the CMV enhancer region.

Figure 31:
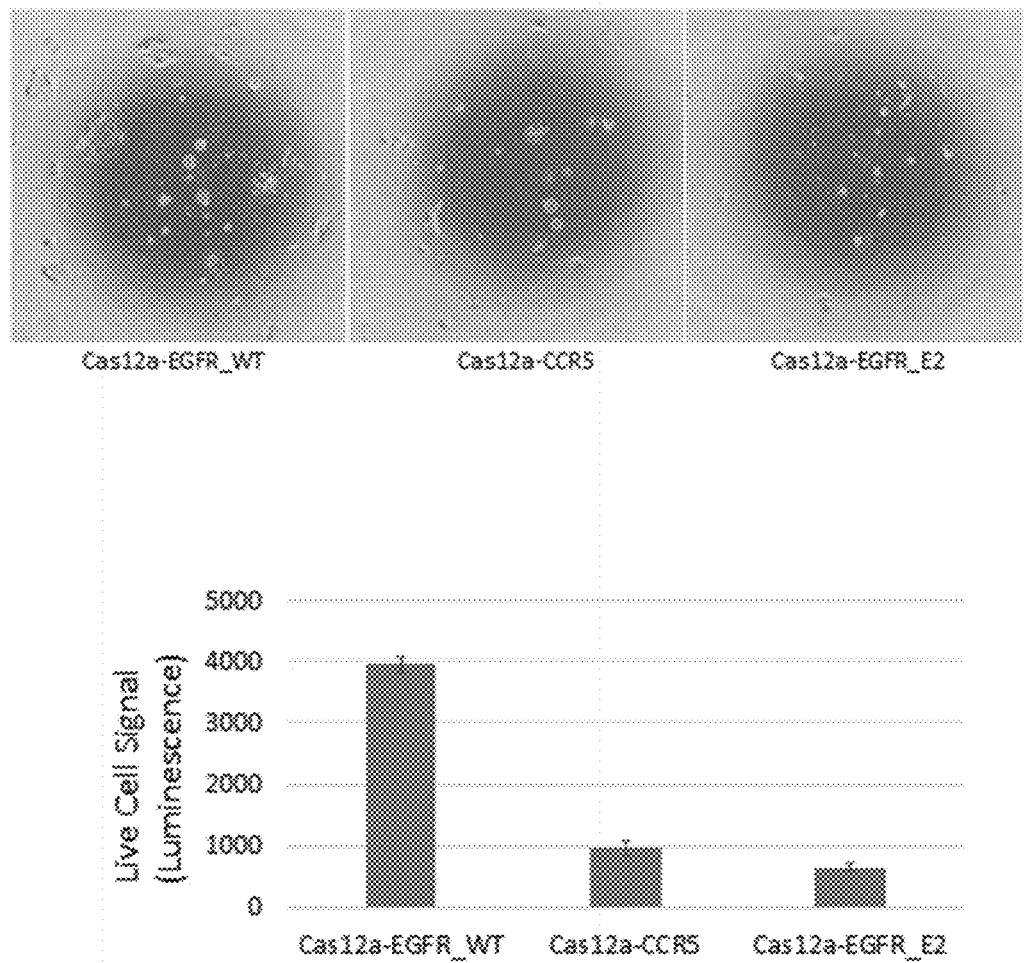
FIG. 31 shows sequence specific cancer cell killing effect by Cas12a and single or multi-target crRNAs, including images of cells at top and a bar graph of the live cells in each treatment group at bottom.

FIG. 31 shows, at top, bright field images of cells in different treatment groups, which are, from left to right, Cas12a-EGFR WT, Cas12a-CCR5, and Cas12a-EGFR E2. At bottom is a bar graph, which on the x-axis shows the different treatment groups of, from left to right, Cas12a-EGFR WT, Cas12a-CCR5, and Cas12a-EGFR E2. The y-axis shows the live cell signal in luminescence ranging from 0 to 4500 in increments of 500.

NUMBERED EMBODIMENTS

The following embodiments recite permutations of combinations of features disclosed herein. In some cases, permutations of combinations of features disclosed herein are non-limiting. In other cases permutations of combinations of features disclosed herein are limiting. Other permutations of combinations of features are also contemplated. In particular, each of these numbered embodiments is contemplated as depending from or relating to every previous or subsequent numbered embodiment, independent of their order as listed. Some methods enumerated herein include up to and all of the following elements a, b, and c. The methods may further include additional elements. 1. A composition to induce cell death, the composition comprising: a) a chimeric polypeptide comprising a first domain comprising sequence-specific endonuclease activity and a second domain comprising exonuclease activity; and b) a guide nucleic acid comprising a sequence complementary to a target nucleic acid in a cell, wherein the target nucleic acid is associated with a disorder. 2. The composition of embodiment 1, wherein the disorder is cancer. 3. The composition of embodiment 2, wherein the cancer is lung cancer or pancreatic cancer. 4. The composition of embodiment 1, wherein the target nucleic acid comprises RNA or DNA. 5. The composition of embodiment 1, wherein the target nucleic acid comprises a sequence associated with the disorder. 6. The composition of embodiment 1, wherein the target nucleic acid is within a region comprising a chromosomal abnormality. 7. The composition of embodiment 5, wherein the chromosomal abnormality is selected from the group consisting of: a translocation, a deletion, a duplication, an inversion, an insertion, a ring, and a isochromosome. 8. The composition of embodiment 1, wherein the target nucleic acid comprises a single nucleotide polymorphism specific to a cancer, a translocation, or a sequence associated with cancer progression. 9. The composition of embodiment 1, wherein the target nucleic acid comprises a portion of a gene selected from the group consisting of: BRCA-1, BRAF, BCR-ABL, and HER2. 10. The composition of embodiment 1, wherein the chimeric polypeptide further comprises inducible non-specific nuclease activity. 11. The composition of embodiment 10, wherein the inducible non-specific nuclease activity is activated by site-specific cleavage of the target nucleic acid by the chimeric polypeptide. 12. The composition of embodiment 1, wherein the first domain comprises a Cas12a (or Cpf1) domain, a Cas12a domain, a Cas12b domain, a Cas12c domain, a Cas12d domain, a Cas12e domain, a Cas12f domain, a Cas12g domain, a Cas12h domain, a Cas12i domain, a Cas13a domain, a Cas13b domain, a Cas14 domain, or a Cas9 domain. 13. The composition of embodiment 1, wherein the first domain comprises a Cas12a (or Cpf1) domain. 14. The composition of embodiment 1, wherein the guide nucleic acid comprises a sequence selected from the group consisting of the sequences listed in Table 6 and paragraph [00303] or Table 7 and paragraph [00305]. 15. The composition of embodiment 1, wherein the guide nucleic acid comprises a first portion and a second portion, wherein the first portion comprises at least about 85% sequence identity to: AATTCTAATACGACTCAC-TATAGgtaatttctactaagtgtagat (SEQ ID NO: 65), wherein the second portion comprises a sequence complementary to a region of a gene associated with cancer. 16. The composition of embodiment 1, wherein the guide nucleic acid comprises a first portion, a second portion, and a third portion, wherein the first portion comprises at least about 85% sequence identity to the sequence: attctaatacgactcactatagg (SEQ ID NO: 3300), wherein the second portion comprises a sequence complementary to a region of a gene associated with cancer, and wherein the third portion comprises at least about 85% sequence identity to the sequence: gttt-tagagctagaaatagcaagttaaaataaggctagtccgttatcaactt-gaaaaagtggcaccgagtcggtgc (SEQ ID NO: 66). 17. The composition of embodiment 1, wherein the first domain is a CRISPR-Associated (Cas) Protein domain that comprises inducible non-specific nuclease activity. 18. The composition of embodiment 17, wherein the inducible non-specific nuclease activity is activated by site-specific cleavage of the target nucleic acid by the first domain. 19. The composition of embodiment 1, wherein the second domain comprises a RecE domain, a RecJ domain, a T5 domain, a Lambda Exonuclease domain, a RecBCD domain, a DNA pol I small fragment domain, an ExoI domain, an ExoII domain, an ExoVII domain, an Exo T domain, a Trex1 domain, or a Trex2 domain. 20. The composition of embodiment 1, wherein the chimeric polypeptide generates a 3' OH overhang. 21. The composition of embodiment 1, wherein the chimeric polypeptide exposes a recessed 3' OH. 22. The composition of embodiment 1, wherein the second domain comprises an enzyme having cleaved end resection activity. 23. The composition of embodiment 1, wherein the second domain comprises mung bean nuclease. 24. The composition of embodiment 1, wherein the chimeric polypeptide and the guide nucleic acid are present as a ribonucleoprotein complex in the composition. 25. The composition of embodiment 1, wherein the guide nucleic acid does not bind to a nucleic acid in a healthy cell. 26. The composition of embodiment 1, wherein the composition is formulated for oral administration. 27. The composition of embodiment 1, wherein the composition is formulated as a pill, a tablet, or a capsule. 28. The composition of embodiment 1, wherein the composition is formulated with an enteric coating. 29. The composition of embodiment 1, wherein the composition is formulated for topical administration. 30. The composition of embodiment 1, wherein the composition is formulated for parenteral administration. 31. The composition of embodiment 1, wherein the composition is formulated for intrathecal administration. 32. The composition of embodiment 1, wherein the composition further comprises an agent to facilitate entry of the composition into a cell comprising the target nucleic acid. 33. The composition of embodiment 1, wherein the composition further comprises a buffer. 34. A method for inducing cell death, the method comprising contacting a target nucleic acid in a cell with a chimeric polypeptide comprising a first domain comprising sequence-specific endonuclease activity and a second domain comprising exonuclease activity, thereby inducing death of the cell. 35. The method of embodiment 34, wherein the cell is a cancer cell. 36. The method of embodiment 34, wherein the target nucleic acid comprises a sequence associated with a disorder. 37. The method of embodiment 36, wherein the disorder is cancer. 38. The method of embodiment 36, wherein the disorder is lung cancer or pancreatic cancer. 39. The method of embodiment 34, wherein the target nucleic acid comprises RNA or DNA. 40. The method of embodiment 34, wherein the target nucleic acid is within a region comprising a chromosomal abnormality. 41. The method of embodiment 34, wherein the chromosomal abnormality is selected from the group consisting of: a translocation, a deletion, a duplication, an inversion, an insertion, a ring, and a isochromosome. 42. The method of embodiment 34, wherein the target nucleic acid comprises a translocation, a single nucleotide polymorphism specific to a cancer, or a sequence associated with cancer progression. 43. The method of embodiment 34, wherein the target nucleic acid comprises a portion of a gene selected from the group consisting of: BRCA-1, BRAF, BCR-ABL, or HER2. 44. The method of embodiment 34, further comprising contacting the target nucleic acid with a guide nucleic acid comprising a sequence complementary to the target nucleic acid. 45. The method of embodiment 44, wherein the guide nucleic acid does not bind to a nucleic acid in a healthy cell. 46. The method of embodiment 34, further comprising site-specifically cleaving the target nucleic acid by the chimeric polypeptide. 47. The method of embodiment 46, further comprising non-specifically cleaving nucleic acids in the cell. 48. The method of embodiment 34, wherein the chimeric polypeptide further comprises inducible non-specific nuclease activity. 49. The method of embodiment 58, wherein the inducible non-specific nuclease activity is activated by site-specific cleavage of the target nucleic acid by the chimeric polypeptide. 50. The method of embodiment 34, wherein the first domain comprises a Cas12a (or Cpf1) domain, a Cas12a domain, a Cas12b domain, a Cas12c domain, a Cas12d domain, a Cas12e domain, a Cas12f domain, a Cas12g domain, a Cas12h domain, a Cas12i domain, a Cas13a domain, a Cas13b domain, a Cas14 domain, or a Cas9 domain. 51. The method of embodiment 34, wherein the first domain comprises a Cas12a (or Cpf1) domain. 52. The method of embodiment 34, wherein the guide nucleic acid comprises a sequence selected from the group consisting of the sequences listed in Table 6 and paragraph [00303] or Table 7 and paragraph [00305]. 53. The composition of embodiment 34, wherein the guide nucleic acid comprises a first portion and a second portion, wherein the first portion comprises at least about 85% sequence identity to: AATTCTAATACGACTCAC-TATAGgtaatttctactaagtgtagat (SEQ ID NO: 65), wherein the second portion comprises a sequence complementary to a region of a gene associated with cancer. 54. The composition of embodiment 34, wherein the guide nucleic acid comprises a first portion, a second portion, and a third portion, wherein the first portion comprises at least about 85% sequence identity to the sequence: attctaatacgactcactatagg (SEQ ID NO: 3300), wherein the second portion comprises a sequence complementary to a region of a gene associated with cancer, and wherein the third portion comprises at least about 85% sequence identity to the sequence: gttt-tagagctagaaatagcaagttaaaataaggctagtccgttatcaactt-gaaaaagtggcaccgagtcggtgc (SEQ ID NO: 66). 55. The method of embodiment 34, wherein the first domain is a CRISPR-Associated (Cas) Protein domain that comprises inducible non-specific nuclease activity. 56. The method of embodiment 55, wherein the inducible non-specific nuclease activity of the first domain is activated by site-specific cleavage of the target nucleic acid by the first domain. 57. The method of embodiment 34, wherein the second domain comprises a RecE domain, a RecJ domain, a T4 domain, a RecBCD domain, a DNA pol I small fragment domain, an ExoI domain, an ExoIII domain, an ExoVII domain, an Exo T domain, a Trex1 domain, or a Trex2 domain. 58. The method of embodiment 34, wherein the chimeric polypeptide generates a 3' OH overhang. 59. The method of embodiment 34, wherein the chimeric polypeptide exposes a recessed 3' OH. 60. The method of embodiment 34, wherein the second domain comprises an enzyme having cleaved end resection activity. 61. The method of embodiment 34, wherein the second domain comprises mung bean nuclease. 62. The method of embodiment 34, wherein the chimeric polypeptide is delivered to the cell in a ribonucleoprotein complex comprising the chimeric polypeptide and a guide nucleic acid comprising a sequence complementary to the target nucleic acid. 63. The method of embodiment 34, further comprising terminating activity of the chimeric polypeptide in the subject after cleavage of the target nucleic acid by the chimeric polypeptide. 64. The method of embodiment 63, wherein the terminating is performed by administering to the subject at least one of: an antibody specific to the chimeric polypeptide or ZnSO4. 65. A composition comprising: a) a chimeric polypeptide comprising a first domain comprising sequence-specific endonuclease activity and a second domain comprising exonuclease activity; and b) a guide nucleic acid comprising: a first section comprising at least 5 consecutive bases comprising complete complementarity to a portion of a first chromosome of a healthy cell, and a second section comprising at least 5 consecutive bases comprising complete complementarity to a portion of a second chromosome of a healthy cell. 66. The composition of embodiment 65, wherein the first section comprises complementarity to a portion of BCR gene and the second section comprises complementarity to a portion of ABL gene. 67. The composition of embodiment 65, wherein the first section comprises complementarity to a portion of TEL gene and the second section comprises complementarity to a portion of AML gene. 68. The composition of embodiment 65, wherein the chimeric polypeptide further comprises inducible non-specific nuclease activity. 69. The composition of embodiment 65, wherein the inducible non-specific nuclease activity is activated by site-specific cleavage of a target nucleic acid by the chimeric polypeptide. 70. The composition of embodiment 65, wherein the first domain comprises a Cas9 domain. 71. The composition of embodiment 65, wherein the first domain comprises a Cas12a (or Cpf1) domain. 72. The composition of embodiment 65, wherein the first domain comprises a Cas13a or Cas13b domain. 73. The composition of embodiment 65, wherein the first domain is a CRISPR-Associated (Cas) Protein domain that comprises inducible non-specific nuclease activity. 74. The composition of embodiment 73, wherein the inducible non-specific nuclease activity is activated by site-specific cleavage of a target nucleic acid by the first domain. 75. The composition of embodiment 65, wherein the second domain comprises a RecE domain, a RecJ domain, a T5 domain, a Lambda Exonuclease domain, a RecJ domain, a T5 domain, a Lambda Exonuclease domain, a RecBCD domain, a DNA pol I small fragment domain, an ExoI domain, an ExoII domain, an ExoVII domain, an Exo T domain, a Trex1 domain, or a Trex1 domain. 76. The composition of embodiment 65, wherein the chimeric polypeptide generates a 3' OH overhang. 77. The composition of embodiment 65, wherein the chimeric polypeptide exposes a recessed 3' OH. 78. The composition of embodiment 65, wherein the second domain comprises a domain having cleaved end resection activity. 79. The composition of embodiment 65, wherein the second domain comprises mung bean nuclease. 80. The composition of embodiment 65, wherein the chimeric polypeptide and the guide nucleic acid are present as a ribonucleoprotein complex in the composition. 81. The composition of embodiment 65, wherein the guide nucleic acid does not bind to a nucleic acid in a healthy cell. 82. The composition of embodiment 65, wherein the composition is formulated for oral administration. 83. The composition of embodiment 65, wherein the composition is formulated as a pill, a tablet, or a capsule. 84. The composition of embodiment 65, wherein the composition is formulated with an enteric coating. 85. The composition of embodiment 65, wherein the composition is formulated for topical administration. 86. The composition of embodiment 65, wherein the composition is formulated for parenteral administration. 87. The composition of embodiment 65, wherein the composition is formulated for intrathecal administration. 88. The composition of embodiment 65, wherein the composition further comprises an agent to facilitate entry of the composition into a cell comprising the target nucleic acid. 89. The composition of embodiment 65, wherein the composition further comprises a buffer. 90. A method for ameliorating a symptom in a subject having cancer, the method comprising contacting a target nucleic acid in the subject with a composition of any one of embodiments 65 to 89. 91. The method of embodiment 90, wherein the target nucleic acid is in a region of chromosomal translocation involving the portion of the first chromosome and the portion of the second chromosome. 92. The method of embodiment 90, wherein the target nucleic acid hybridizes with the first section and the second section of the guide nucleic acid. 93. The method of embodiment 90, further comprising administering the composition to the subject, wherein chimeric polypeptide and the guide nucleic acid are in a ribonucleoprotein complex in the composition. 94. The method of embodiment 90, further comprising terminating activity of the chimeric polypeptide in the subject after cleavage of the target nucleic acid by the chimeric polypeptide. 95. The method of embodiment 90, wherein the terminating is performed by administering to the subject an antibody specific to the chimeric polypeptide. 96. The method of embodiment 90, wherein the terminating is performed by administering to the subject ZnSO4. 97. A composition for targeting a pathogen, the composition comprising: a) a chimeric polypeptide comprising a first domain comprising sequence-specific endonuclease activity and a second domain comprising exonuclease activity; and b) a guide nucleic acid comprising a sequence complementary to a target nucleic acid of a pathogen. 98. The composition of embodiment 97, wherein the target nucleic acid comprises RNA. 99. The composition of embodiment 97, wherein the target nucleic acid comprises DNA. 100. The composition of embodiment 97, wherein the pathogen is a virus. 101. The composition of embodiment 97, wherein the pathogen is a bacterium. 102. The composition of embodiment 97, wherein the chimeric polypeptide further comprises inducible non-specific nuclease activity. 103. The composition of embodiment 102, wherein the inducible non-specific nuclease activity is activated by site-specific cleavage of the target nucleic acid by the chimeric polypeptide. 104. The composition of embodiment 97, wherein the first domain comprises a Cas12a (or Cpf1) domain. 105. The composition of embodiment 97, wherein the first domain comprises a Cas13a or Cas13b domain. 106. The composition of embodiment 97, wherein the first domain comprises a Cas9 domain. 107. The composition of embodiment 97, wherein the first domain is a CRISPR-Associated (Cas) Protein domain that comprises inducible non-specific nuclease activity. 108. The composition of embodiment 107, wherein the inducible non-specific nuclease activity of the first domain is activated by site-specific cleavage of the target nucleic acid by the first domain. 109. The composition of embodiment 97, wherein the second domain comprises a RecE domain, a RecJ domain, a T5 domain, a Lambda Exonuclease domain, a RecBCD domain, a DNA pol I small fragment domain, an ExoI domain, an ExoIII domain, an ExoVII domain, an Exo T domain, a Trex1 domain, or a Trex2 domain. 110. The composition of embodiment 97, wherein the chimeric polypeptide generates a 3' OH overhang. 111. The composition of embodiment 97, wherein the chimeric polypeptide exposes a recessed 3' OH. 112. The composition of embodiment 97, wherein the second domain comprises an enzyme having cleaved end resection activity. 113. The composition of embodiment 97, wherein the second domain comprises mung bean nuclease. 114. The composition of embodiment 97, wherein the chimeric polypeptide and the guide nucleic acid are present as a ribonucleoprotein complex in the composition. 115. The composition of embodiment 97, wherein the guide nucleic acid does not bind to a host nucleic acid. 116. The composition of embodiment 97, wherein the composition is formulated for oral administration. 117. The composition of embodiment 97, wherein the composition is formulated as a pill, a tablet, or a capsule. 118. The composition of embodiment 97, wherein the composition is formulated with an enteric coating. 119. The composition of embodiment 97, wherein the composition is formulated for topical administration. 120. The composition of embodiment 97, wherein the composition is formulated for parenteral administration. 121. The composition of embodiment 97, wherein the composition is formulated for intrathecal administration. 122. The composition of embodiment 97, wherein the composition further comprises an agent to facilitate entry of the composition into a cell comprising the target nucleic acid. 123. The composition of embodiment 97, wherein the composition further comprises a buffer. 124. A method for targeting a pathogen in a subject, the method comprising contacting a target nucleic acid of a pathogen in the subject with a composition of any one of embodiments 97 to 123. 125. The method of embodiment 124, wherein the chimeric polypeptide cleaves the target nucleic acid. 126. The method of embodiment 124, further comprising administering the composition to the subject, wherein chimeric polypeptide and the guide nucleic acid are in a ribonucleoprotein complex in the composition. 127. The method of embodiment 124, further comprising terminating activity of the chimeric polypeptide in the subject after cleavage of the target nucleic acid by the chimeric polypeptide. 128. The method of embodiment 124, wherein the terminating is performed by administering to the subject an antibody specific to the chimeric polypeptide. 129. The method of embodiment 124, wherein the terminating is performed by administering to the subject ZnSO4. 130. A method for ameliorating a symptom in a subject having a disorder, the method comprising administering to the subject a ribonucleoprotein complex comprising: (i) a polypeptide comprising sequence-specific endonuclease activity; and (ii) a guide nucleic acid comprising a sequence complementary to a target nucleic acid in the subject. 131. The method of embodiment 130, wherein the disorder is cancer. 132. The method of embodiment 130, wherein the disorder is lung cancer or pancreatic cancer. 133. The method of embodiment 130, wherein the target nucleic acid comprises a sequence associated with the disorder. 134. The method of embodiment 130, wherein the target nucleic acid comprises RNA. 135. The method of embodiment 130, wherein the target nucleic acid comprises DNA. 136. The method of embodiment 130, wherein the target nucleic acid is in a cancer cell of the subject. 137. The method of embodiment 130, wherein the target nucleic acid is absent in a healthy cell of the subject. 138. The method of embodiment 130, wherein the target nucleic acid is within a region comprising a chromosomal abnormality. 139. The method of embodiment 138, wherein the chromosomal abnormality is selected from the group consisting of: a translocation, a deletion, a duplication, an inversion, an insertion, a ring, and a isochromosome. 140. The method of embodiment 139, wherein the target nucleic acid comprises a translocation. 141. The method of embodiment 130, wherein the target nucleic acid comprises a single nucleotide polymorphism specific to a cancer. 142. The method of embodiment 130, wherein the target nucleic acid comprises a sequence associated with cancer progression. 143. The method of embodiment 130, wherein the target nucleic acid comprises a portion of a gene selected from the group consisting of: BRCA-1, BRAF, BCR-ABL, or HER2. 144. The method of embodiment 130, wherein the guide nucleic acid does not bind to a nucleic acid in a healthy cell. 145. The method of embodiment 130, further comprising site-specifically cleaving the target nucleic acid by the polypeptide. 146. The method of embodiment 130, further comprising non-specifically cleaving other nucleic acids in a cell comprising the target nucleic acid by the polypeptide. 147. The method of embodiment 130, wherein the polypeptide further comprises inducible non-specific nuclease activity. 148. The method of embodiment 147, wherein the inducible non-specific nuclease activity is activated by site-specific cleavage of the target nucleic acid by the polypeptide. 149. The method of embodiment 130, wherein the polypeptide comprises a Cas12a (or Cpf1) domain. 150. The method of embodiment 130, wherein the polypeptide comprises a Cas13a or Cas13b domain. 151. The method of embodiment 130, wherein the polypeptide comprises a Cas9 domain. 152. The method of embodiment 130, wherein the guide nucleic acid comprises a sequence selected from the group consisting of the sequences listed in Table 6 and paragraph [00303] or Table 7 and paragraph [00305]. 153. The composition of embodiment 130, wherein the guide nucleic acid comprises a first portion and a second portion, wherein the first portion comprises at least about 85% sequence identity to: AATTCTAATACGACTCACTATAGgtaatttctactaagtgtagat (SEQ ID NO: 65), wherein the second portion comprises a sequence complementary to a region of a gene associated with cancer. 154. The composition of embodiment 130, wherein the guide nucleic acid comprises a first portion, a second portion, and a third portion, wherein the first portion comprises at least about 85% sequence identity to the sequence: attctaatacgactcactatagg (SEQ ID NO: 3300), wherein the second portion comprises a sequence complementary to a region of a gene associated with cancer, and wherein the third portion comprises at least about 85% sequence identity to the sequence: gttttagagctagaaatagcaagttaaaataaggctagtccgttatcaacttgaaaaagtggcaccgagtcggtgc (SEQ ID NO: 66). 155. The method of embodiment 130, wherein the polypeptide is a CRISPR-Associated (Cas) Protein domain that comprises inducible non-specific nuclease activity. 156. The method of embodiment 155, wherein the polypeptide is a chimeric polypeptide comprising a first domain comprising the sequence-specific endonuclease activity and a second domain comprising exonuclease activity. 157. The method of embodiment 156, wherein the second domain comprises a RecE domain, a RecJ domain, a T5 domain, a Lambda Exonuclease domain, a RecBCD domain, a DNA pol I small fragment domain, an ExoI domain, an ExoIII domain, an ExoVII domain, an Exo T domain, a Trex1 domain, or a Trex2 domain. 158. The method of embodiment 156, wherein the chimeric polypeptide generates a 3' OH overhang. 159. The method of embodiment 156, wherein the chimeric polypeptide exposes a recessed 3' OH. 160. The method of embodiment 156, wherein the second domain comprises an enzyme having cleaved end resection activity. 161. The method of embodiment 156, wherein the second domain comprises mung bean nuclease. 162. The method of embodiment 130, further comprising terminating activity of the polypeptide in the subject after cleavage of the target nucleic acid by the polypeptide. 163. The method of embodiment 130, wherein the terminating is performed by administering to the subject an antibody specific to the polypeptide. 164. The method of embodiment 130, wherein the terminating is performed by administering to the subject ZnSO4. 165. A method for ameliorating a symptom in a subject having cancer, the method comprising a) administering to the subject a therapy selected from the group consisting of: chemotherapy, radiation therapy, immunotherapy, hormone therapy, and any combination thereof; and b) contacting a target nucleic acid in the subject with a chimeric polypeptide comprising a first domain comprising sequence-specific endonuclease activity and a second domain comprising exonuclease activity. 166. The method of embodiment 165, wherein the therapy is immunotherapy. 167. The method of embodiment 166, wherein the immunotherapy comprises CAR T-cell therapy. 168. The method of embodiment 166, wherein the immunotherapy comprises administering trastuzumab 169. The method of embodiment 165, wherein the therapy is chemotherapy. 170. The method of embodiment 169, wherein the chemotherapy comprises administering imatinib mesylate. 171. The method of embodiment 165, wherein the combination of a) and b) provides an enhanced therapeutic effect compared to the therapeutic effect of a) or b) alone. 172. The method of embodiment 165, wherein the target nucleic acid is in a cancer cell of the subject. 173. The method of embodiment 165, wherein the target nucleic acid is absent in a healthy cell of the subject. 174. The method of embodiment 165, wherein the target nucleic acid comprises a sequence associated with the cancer. 175. The method of embodiment 165, wherein the target nucleic acid comprises RNA. 176. The method of embodiment 165, wherein the target nucleic acid comprises DNA. 177. The method of embodiment 165, wherein the target nucleic acid is within a region comprising a chromosomal abnormality. 178. The method of embodiment 177, wherein the chromosomal abnormality is selected from the group consisting of: a translocation, a deletion, a duplication, an inversion, an insertion, a ring, and a isochromosome. 179. The method of embodiment 177, wherein the target nucleic acid comprises a translocation. 180. The method of embodiment 165, wherein the target nucleic acid comprises a single nucleotide polymorphism specific to a cancer. 181. The method of embodiment 165, wherein the target nucleic acid comprises a sequence associated with cancer progression. 182. The method of embodiment 165, wherein the target nucleic acid comprises a portion of a gene selected from the group consisting of: BRCA-1, BRAF, BCR-ABL, or HER2. 183. The method of embodiment 165, further comprising contacting the target nucleic acid with a guide nucleic acid comprising a sequence complementary to the target nucleic acid. 184. The method of embodiment 183, wherein the guide nucleic acid does not bind to a nucleic acid in a healthy cell. 185. The method of embodiment 183, wherein the guide nucleic acid comprises a sequence selected from the group consisting of the sequences listed in Table 6 and paragraph [00303] or Table 7 and paragraph [00305]. 186. The composition of embodiment 183, wherein the guide nucleic acid comprises a first portion and a second portion, wherein the first portion comprises at least about 85% sequence identity to: AATTCTAATACGACTCAC-TATAGgtaatttctactaagtgtagat (SEQ ID NO: 65), wherein the second portion comprises a sequence complementary to a region of a gene associated with cancer. 187. The composition of embodiment 183, wherein the guide nucleic acid comprises a first portion, a second portion, and a third portion, wherein the first portion comprises at least about 85% sequence identity to the sequence: attctaatacgactcactatagg (SEQ ID NO: 3300), wherein the second portion comprises a sequence complementary to a region of a gene associated with cancer, and wherein the third portion comprises at least about 85% sequence identity to the sequence: gttttagagctagaaatagcaagttaaaataaggctagtccgttatcaacttgaaaaagtggcaccgagtcggtgc (SEQ ID NO: 66). 188. The method of embodiment 165, further comprising site-specifically cleaving the target nucleic acid by the chimeric polypeptide. 189. The method of embodiment 165, further comprising non-specifically cleaving other nucleic acids in a cell comprising the target nucleic acids by the chimeric polypeptide. 190. The method of embodiment 165, wherein the chimeric polypeptide further comprises inducible non-specific nuclease activity. 191. The method of embodiment 165, wherein the inducible non-specific nuclease activity is activated by site-specific cleavage of the target nucleic acid by the chimeric polypeptide. 192. The method of embodiment 165, wherein the first domain comprises a Cas12a (or Cpf1) domain. 193. The method of embodiment 165, wherein the first domain comprises a Cas13a or Cas13b domain. 194. The method of embodiment 165, wherein the first domain comprises a Cas9 domain. 195. The method of embodiment 165, wherein the first domain is a CRISPR-Associated (Cas) Protein domain that comprises inducible non-specific nuclease activity. 196. The method of embodiment 195, wherein the inducible non-specific nuclease activity of the first domain is activated by site-specific cleavage of the target nucleic acid by the first domain. 197. The method of embodiment 165, wherein the second domain comprises a RecE domain, a RecJ domain, a T5 domain, a Lambda Exonuclease domain, a RecBCD domain, a DNA pol I small fragment domain, an ExoI domain, an ExoIII domain, an ExoVII domain, an Exo T domain, a Trex1 domain, or a Trex2 domain. 198. The method of embodiment 165, wherein the chimeric polypeptide generates a 3' OH overhang. 199. The method of embodiment 165, wherein the chimeric polypeptide exposes a recessed 3' OH. 200. The method of embodiment 165, wherein the second domain comprises an enzyme having cleaved end resection activity. 201. The method of embodiment 165, wherein the second domain comprises mung bean nuclease. 202. The method of embodiment 165, wherein the chimeric polypeptide is delivered to the cell in a ribonucleoprotein complex comprising the chimeric polypeptide and a guide nucleic acid comprising a sequence complementary to the target nucleic acid. 203. The method of embodiment 165, further comprising terminating activity of the chimeric polypeptide in the subject after cleavage of the target nucleic acid by the chimeric polypeptide. 204. The method of embodiment 203, wherein the terminating is performed by administering to the subject an antibody specific to the chimeric polypeptide. 205. The method of embodiment 203, wherein the terminating is performed by administering to the subject ZnSO4. 206. A method for ameliorating a symptom in a subject having cancer, the method comprising a) quantifying a first health condition of the subject at a first time point; b) administering to the subject a therapy selected from the group consisting of: chemotherapy, radiation therapy, immunotherapy, hormone therapy, and any combination thereof; c) quantifying a second health condition of the subject at a second time point after the therapy; d) contacting a target nucleic acid in the subject with a chimeric polypeptide comprising a first domain comprising sequence-specific endonuclease activity and a second domain comprising exonuclease activity; and e) quantifying a third health condition of the subject at a third time point after the contacting. 207. The method of embodiment 206, wherein the quantifying the first health condition, the second health condition, or the third health condition comprises use of one or more of: biopsy, imaging test, genetic test, tumor molecular profiling, laboratory test, or nucleic acid sequencing. 208. The method of embodiment 206, wherein the therapy is immunotherapy. 209. The method of embodiment 208, wherein the immunotherapy comprises CAR T-cell therapy. 210. The method of embodiment 208, wherein the immunotherapy comprises administering trastuzumab 211. The method of embodiment 206, wherein the therapy is chemotherapy. 212. The method of embodiment 211, wherein the chemotherapy comprises administering imatinib mesylate. 213. The method of embodiment 206, wherein the third health condition of the subject is better than the first health condition and the second health condition. 214. The method of embodiment 206, wherein the target nucleic acid is in a cancer cell of the subject. 215. The method of embodiment 206, wherein the target nucleic acid is absent in a healthy cell of the subject. 216. The method of embodiment 206, wherein the target nucleic acid comprises a sequence associated with the cancer. 217. The method of embodiment 206, wherein the target nucleic acid comprises RNA. 218. The method of embodiment 206, wherein the target nucleic acid comprises DNA. 219. The method of embodiment 206, wherein the target nucleic acid is within a region comprising a chromosomal abnormality. 220. The method of embodiment 219, wherein the chromosomal abnormality is selected from the group consisting of: a translocation, a deletion, a duplication, an inversion, an insertion, a ring, and a isochromosome. 221. The method of embodiment 219, wherein the target nucleic acid comprises a translocation. 222. The method of embodiment 206, wherein the target nucleic acid comprises a single nucleotide polymorphism specific to a cancer. 223. The method of embodiment 206, wherein the target nucleic acid comprises a sequence associated with cancer progression. 224. The method of embodiment 206, wherein the target nucleic acid comprises a portion of a gene selected from the group consisting of: BRCA-1, BRAF, BCR-ABL, or HER2. 225. The method of embodiment 206, further comprising contacting the target nucleic acid with a guide nucleic acid comprising a sequence complementary to the target nucleic acid. 226. The method of embodiment 225, wherein the guide nucleic acid does not bind to a nucleic acid in a healthy cell. 227. The method of embodiment 225, wherein the guide nucleic acid comprises a sequence selected from the group consisting of the sequences listed in Table 6 and paragraph [00303] or Table 7 and paragraph [00305]. 228. The composition of embodiment 225, wherein the guide nucleic acid comprises a first portion and a second portion, wherein the first portion comprises at least about 85% sequence identity to: AATTCTAATACGACTCAC-TATAGgtaatttctactaagtgtagat (SEQ ID NO: 65), wherein the second portion comprises a sequence complementary to a region of a gene associated with cancer. 229. The composition of embodiment 225, wherein the guide nucleic acid comprises a first portion, a second portion, and a third portion, wherein the first portion comprises at least about 85% sequence identity to the sequence: attctaatacgactcac-tatagg (SEQ ID NO: 3300), wherein the second portion comprises a sequence complementary to a region of a gene associated with cancer, and wherein the third portion comprises at least about 85% sequence identity to the sequence: gttttagagctagaaatagcaagttaaaataaggctagtccgttatcaactt-gaaaaagtggcaccgagtcggtgc (SEQ ID NO: 66). 230. The method of embodiment 206, further comprising site-specifically cleaving the target nucleic acid by the chimeric polypeptide. 231. The method of embodiment 206, further comprising non-specifically cleaving other nucleic acids in a cell comprising the target nucleic acids by the chimeric polypeptide. 232. The method of embodiment 206, wherein the chimeric polypeptide further comprises inducible non-specific nuclease activity. 233. The method of embodiment 232, wherein the inducible non-specific nuclease activity is activated by site-specific cleavage of the target nucleic acid by the chimeric polypeptide. 234. The method of embodiment 206, wherein the first domain comprises a Cas12a (or Cpf1) domain. 235. The method of embodiment 206, wherein the first domain comprises a Cas13a or Cas13b domain. 236. The method of embodiment 206, wherein the first domain comprises a Cas9 domain. 237. The method of embodiment 206, wherein the first domain is a CRISPR-Associated (Cas) Protein domain that comprises inducible non-specific nuclease activity. 238. The method of embodiment 237, wherein the inducible non-specific nuclease activity of the first domain is activated by site-specific cleavage of the target nucleic acid by the first domain. 239. The method of embodiment 206, wherein the second domain comprises a RecE domain, a RecJ domain, a T5 domain, a Lambda Exonuclease domain, a RecBCD domain, a DNA pol I small fragment domain, an ExoI domain, an ExoIII domain, an ExoVII domain, an Exo T domain, a Trex1 domain, or a Trex2 domain. 240. The method of embodiment 206, wherein the chimeric polypeptide generates a 3' OH overhang. 241. The method of embodiment 206, wherein the chimeric polypeptide exposes a recessed 3' OH. 242. The method of embodiment 206, wherein the second domain comprises an enzyme having cleaved end resection activity. 243. The method of embodiment 206, wherein the second domain comprises mung bean nuclease. 244. The method of embodiment 206, wherein the chimeric polypeptide is delivered to the cell in a ribonucleoprotein complex comprising the chimeric polypeptide and a guide nucleic acid comprising a sequence complementary to the target nucleic acid. 245. The method of embodiment 206, further comprising terminating activity of the chimeric polypeptide in the subject after cleavage of the target nucleic acid by the chimeric polypeptide. 246. The method of embodiment 245, wherein the terminating is performed by administering to the subject an antibody specific to the chimeric polypeptide. 247. The method of embodiment 245, wherein the terminating is performed by administering to the subject ZnSO4. 248. A method for terminating activity of a polypeptide in a subject, the method comprising: a) cleaving a target nucleic acid in a subject with a polypeptide comprising sequence-specific endonuclease activity; and b) terminating activity of the polypeptide in the subject. 249. The method of embodiment 248, wherein the terminating comprises administering to the subject an antibody specific to the polypeptide. 250. The method of embodiment 248, wherein the terminating comprises administering to the subject ZnSO4. 251. The method of embodiment 248, wherein the subject has a disorder. 252. The method of embodiment 251, wherein the disorder is cancer. 253. The method of embodiment 251, wherein the disorder is lung cancer or pancreatic cancer. 254. The method of embodiment 251, wherein the target nucleic acid comprises a sequence associated with the disorder. 255. The method of embodiment 248, wherein the target nucleic acid comprises RNA. 256. The method of embodiment 248, wherein the target nucleic acid comprises DNA. 257. The method of embodiment 248, wherein the target nucleic acid is in a cancer cell of the subject. 258. The method of embodiment 248, wherein the target nucleic acid is absent in a healthy cell of the subject. 259. The method of embodiment 248, wherein the target nucleic acid is within a region comprising a chromosomal abnormality. 260. The method of embodiment 248, wherein the chromosomal abnormality is selected from the group consisting of: a translocation, a deletion, a duplication, an inversion, an insertion, a ring, and a isochromosome. 261. The method of embodiment 260, wherein the target nucleic acid comprises a translocation. 262. The method of embodiment 248, wherein the target nucleic acid comprises a single nucleotide polymorphism specific to a cancer. 263. The method of embodiment 248, wherein the target nucleic acid comprises a sequence associated with cancer progression. 264. The method of embodiment 248, wherein the target nucleic acid comprises a portion of a gene selected from the group consisting of: BRCA-1, BRAF, BCR-ABL, or HER2. 265. The method of embodiment 248, wherein the guide nucleic acid does not bind to a nucleic acid in a healthy cell. 266. The method of embodiment 248, further comprising site-specifically cleaving the target nucleic acid by the polypeptide. 267. The method of embodiment 248, further comprising non-specifically cleaving other nucleic acids in a cell comprising the target nucleic acid by the polypeptide. 268. The method of embodiment 248, wherein the polypeptide further comprises inducible non-specific nuclease activity. 269. The method of embodiment 248, wherein the inducible non-specific nuclease activity is activated by site-specific cleavage of the target nucleic acid by the polypeptide. 270. The method of embodiment 248, wherein the polypeptide comprises a Cas12a (or Cpf1) domain. 271. The method of embodiment 248, wherein the polypeptide comprises a Cas13a or Cas13b domain. 272. The method of embodiment 248, wherein the polypeptide comprises a Cas9 domain. 273. The method of embodiment 248, wherein the polypeptide is a CRISPR-Associated (Cas) Protein domain that comprises inducible non-specific nuclease activity. 274. The method of embodiment 248, wherein the polypeptide is a chimeric polypeptide comprising a first domain comprising the sequence-specific endonuclease activity and a second domain comprising exonuclease activity. 275. The method of embodiment 248, wherein the second domain comprises a RecE domain, a RecJ domain, a T5 domain, a Lambda Exonuclease domain, a RecBCD domain, a DNA pol I small fragment domain, an ExoI domain, an ExoIII domain, an ExoVII domain, an Exo T domain, a Trex1 domain, or a Trex2 domain. 276. The method of embodiment 248, wherein the chimeric polypeptide generates a 3' OH overhang. 277. The method of embodiment 248, wherein the chimeric polypeptide exposes a recessed 3' OH. 278. The method of embodiment 248, wherein the second domain comprises an enzyme having cleaved end resection activity. 279. The method of embodiment 248, wherein the second domain comprises mung bean nuclease. 280. A composition for targeting two or more nucleic acids, the composition comprising a) a chimeric polypeptide comprising a first domain comprising sequence-specific endonuclease activity and a second domain comprising exonuclease activity; and b) two or more guide nucleic acids, wherein each guide nucleic acid comprises a sequence complementary to a different target nucleic acid in a cell. 281. The composition of embodiment 280, wherein the target nucleic acids comprise RNA. 282. The composition of embodiment 280, wherein the target nucleic acids comprise DNA. 283. The composition of embodiment 280, wherein the target nucleic acids comprise a sequence associated with the disorder. 284. The composition of embodiment 283, wherein the disorder is cancer. 285. The composition of embodiment 283, wherein the disorder is lung cancer or pancreatic cancer. 286. The composition of embodiment 283, wherein the guide nucleic acids comprise a sequence selected from the group consisting of the sequences in Table 6 and paragraph [00303] or Table 7 and paragraph [00305]. 287. The composition of embodiment 283, wherein the guide nucleic acid comprises a first portion and a second portion, wherein the first portion comprises at least about 85% sequence identity to: AATTCTAATACGACTCACTATAGgtaatttctactaagtgtagat (SEQ ID NO: 65), wherein the second portion comprises a sequence complementary to a region of a gene associated with cancer. 288. The composition of embodiment 283, wherein the guide nucleic acid comprises a first portion, a second portion, and a third portion, wherein the first portion comprises at least about 85% sequence identity to the sequence: attctaatacgactcactatagg (SEQ ID NO: 3300), wherein the second portion comprises a sequence complementary to a region of a gene associated with cancer, and wherein the third portion comprises at least about 85% sequence identity to the sequence: gttttagagctagaaatagcaagttaaaataaggctagtccgttatcaacttgaaaaagtggcaccgagtcggtgc (SEQ ID NO: 66). 289. The composition of embodiment 280, wherein the cell is a cancer cell. 290. The composition of embodiment 280, wherein the target nucleic acids are within regions comprising a chromosomal abnormality. 291. The composition of embodiment 290, wherein the chromosomal abnormality is selected from the group consisting of: a translocation, a deletion, a duplication, an inversion, an insertion, a ring, and a isochromosome. 292. The composition of embodiment 280, wherein the target nucleic acids comprise a single nucleotide polymorphism specific to a cancer. 293. The composition of embodiment 291, wherein the target nucleic acids comprise a translocation. 294. The composition of embodiment 280, wherein the target nucleic acids comprise a sequence associated with cancer progression. 295. The composition of embodiment 280, wherein the target nucleic acids comprise a portion of a gene selected from the group consisting of: BRCA-1, BRAF, BCR-ABL, or HER2. 296. The composition of embodiment 280, wherein the chimeric polypeptide further comprises inducible non-specific nuclease activity. 297. The composition of embodiment 296, wherein the inducible non-specific nuclease activity is activated by site-specific cleavage of the target nucleic acids by the chimeric polypeptide. 298. The composition of embodiment 280, wherein the first domain comprises a Cas12a (or Cpf1) domain. 299. The composition of embodiment 280, wherein the first domain comprises a Cas13a or Cas13b domain. 300. The composition of embodiment 280, wherein the first domain comprises a Cas9 domain. 301. The composition of embodiment 280, wherein the first domain is a CRISPR-Associated (Cas) Protein domain that comprises inducible non-specific nuclease activity. 302. The composition of embodiment 301, wherein the inducible non-specific nuclease activity of the first domain is activated by site-specific cleavage of the target nucleic acids by the first domain. 303. The composition of embodiment 280, wherein the second domain comprises a RecE domain, a RecJ domain, a T5 domain, a Lambda Exonuclease domain, a RecBCD domain, a DNA pol I small fragment domain, an ExoI domain, an ExoIII domain, an ExoVII domain, an Exo T domain, a Trex1 domain, or a Trex2 domain. 304. The composition of embodiment 280, wherein the chimeric polypeptide generates a 3' OH overhang. 305. The composition of embodiment 280, wherein the chimeric polypeptide exposes a recessed 3' OH. 306. The composition of embodiment 280, wherein the second domain comprises an enzyme having cleaved end resection activity. 307. The composition of embodiment 280, wherein the second domain comprises mung bean nuclease. 308. The composition of embodiment 280, wherein the guide nucleic acids do not bind to nucleic acids in a healthy cell. 309. The composition of embodiment 280, wherein the composition comprises one or more ribonucleoprotein complexes, wherein each ribonucleoprotein complex comprises the chimeric polypeptide and a guide nucleic acid from the two or more guide nucleic acids. 310. The composition of embodiment 280, wherein the composition is formulated for oral administration. 311. The composition of embodiment 280, wherein the composition is formulated as a pill, a tablet, or a capsule. 312. The composition of embodiment 280, wherein the composition is formulated with an enteric coating. 313. The composition of embodiment 280, wherein the composition is formulated for topical administration. 314. The composition of embodiment 280, wherein the composition is formulated for parenteral administration. 315. The composition of embodiment 280, wherein the composition is formulated for intrathecal administration. 316. The composition of embodiment 280, wherein the composition further comprises an agent to facilitate entry of the composition into a cell comprising the target nucleic acid. 317. The composition of embodiment 280, wherein the composition further comprises a buffer. 318. A method for ameliorating a symptom of a subject having a disorder, the method comprising contacting target nucleic acids in the subject with a composition of any one of embodiments 280 to 317. 319. The method of embodiment 318, wherein the disorder is cancer. 320. The method of embodiment 318, wherein the disorder is lung cancer or pancreatic cancer. 321. The method of embodiment 318, further comprising cleaving the target nucleic acids by the chimeric polypeptide. 322. The method of embodiment 318, further comprising inducing death of the cell. 323. The method of embodiment 318, further comprising terminating activity of the chimeric polypeptide in the subject after cleavage of the target nucleic acids by the chimeric polypeptide. 324. The method of embodiment 323, wherein the terminating is performed by administering to the subject an antibody specific to the chimeric polypeptide. 325. The method of embodiment 323, wherein the terminating is performed by administering to the subject ZnSO4. 326. A method for ameliorating a symptom in a subject having cancer, the method comprising: a) obtaining a biological sample of the subject; b) determining sequence information of nucleic acids in the biological sample; c) identifying a target nucleic acid from the sequence information, wherein the target nucleic acid is associated with the cancer; d) administering a composition comprising a ribonucleoprotein complex comprising a chimeric polypeptide comprising a first domain comprising sequence-specific endonuclease activity and a second domain comprising exonuclease activity; and a guide nucleic acid comprising a sequence complementary to a portion of the target nucleic acid e) site-specifically cleaving the target nucleic acid by the chimeric polypeptide in a cancer cell in the subject; f) non-specific cleaving other nucleic acids in the cancer cell by the chimeric polypeptide, thereby inducing cell death of the cancer cell; and g) administering to the subject a terminator, thereby terminating activity of the chimeric polypeptide. 327. The method of embodiment 326, wherein the biological sample is selected from the group consisting of: blood, plasma, saliva, body fluid, tumor sample, biopsy sample, sample comprising cell-free nucleic acids, or any combination thereof 328. The method of embodiment 326, wherein the determining comprises sequencing. 329. The method of embodiment 326, wherein the target nucleic acid is absent in a healthy cell of the subject. 330. The method of embodiment 326, wherein the terminator is an antibody specific to the chimeric polypeptide. 331. The method of embodiment 326, wherein the terminator is ZnSO4. 332. The method of embodiment 326, wherein the target nucleic acid comprises RNA. 333. The method of embodiment 326, wherein the target nucleic acid comprises DNA. 334. The method of embodiment 326, wherein the target nucleic acid is within a region comprising a chromosomal abnormality. 335. The method of embodiment 334, wherein the chromosomal abnormality is selected from the group consisting of: a translocation, a deletion, a duplication, an inversion, an insertion, a ring, and a isochromosome. 336. The method of embodiment 334, wherein the target nucleic acid comprises a translocation. 337. The method of embodiment 326, wherein the target nucleic acid comprises a single nucleotide polymorphism specific to a cancer. 338. The method of embodiment 326, wherein the target nucleic acid comprises a sequence associated with cancer progression. 339. The method of embodiment 326, wherein the target nucleic acid comprises a portion of a gene selected from the group consisting of: BRCA-1, BRAF, BCR-ABL, or HER2. 340. The method of embodiment 326, wherein the guide nucleic acid does not bind to a nucleic acid in a healthy cell. 341. The method of embodiment 326, wherein the chimeric polypeptide further comprises inducible non-specific nuclease activity. 342. The method of embodiment 341, wherein the non-specific nuclease activity is activated by site-specific cleavage of the target nucleic acid by the chimeric polypeptide. 343. The method of embodiment 326, wherein the first domain comprises a Cas12a (or Cpf1) domain. 344. The method of embodiment 326, wherein the first domain comprises a Cas13a or Cas13b domain. 345. The method of embodiment 326, wherein the first domain comprises a Cas9 domain. 346. The method of embodiment 326, wherein the guide nucleic acid comprises a sequence selected from the group consisting of sequences in Table 6 and paragraph [00303] or Table 7 and paragraph [00305]. 347. The method of embodiment 326, wherein the first domain is a CRISPR-Associated (Cas) Protein domain that comprises inducible non-specific nuclease activity. 348. The method of embodiment 347, wherein the inducible non-specific nuclease activity of the first domain is activated by site-specific cleavage of the target nucleic acid by the first domain. 349. The method of embodiment 326, wherein the second domain comprises a RecE domain, a RecJ domain, a T5 domain, a Lambda Exonuclease domain, a RecBCD domain, a DNA pol I small fragment domain, an ExoI domain, an ExoIII domain, an ExoVII domain, an Exo T domain, a Trex1 domain, or a Trex2 domain. 350. The method of embodiment 326, wherein the chimeric polypeptide generates a 3' OH overhang. 351. The method of embodiment 326, wherein the chimeric polypeptide exposes a recessed 3' OH. 352. The method of embodiment 326, wherein the second domain comprises an enzyme having cleaved end resection activity. 353. The method of embodiment 326, wherein the second domain comprises mung bean nuclease. 354. A method of selectively inducing cell death in a cell, the method comprising: a) administering a chimeric polypeptide comprising a first domain comprising sequence-specific endonuclease activity and a second domain comprising exonuclease activity a guide nucleic acid comprising a sequence complementary to a target nucleic acid in the cell; and b) cleaving the target nucleic acid, thereby inducing cell death. 355. The method of embodiments 354, wherein the target nucleic acid is associated with a disorder. 356. The method of embodiment 354, wherein the target nucleic acid is in a cancer cell of the subject. 357. The method of embodiment 354, wherein the target nucleic acid is absent in a healthy cell of the subject. 358. The method of embodiment 354, wherein the target nucleic acid comprises a sequence associated with the cancer. 359. The method of embodiment 354, wherein the target nucleic acid comprises RNA. 360. The method of embodiment 354, wherein the target nucleic acid comprises DNA. 361. The method of embodiment 354, wherein the target nucleic acid is within a region comprising a chromosomal abnormality. 362. The method of embodiment 361, wherein the chromosomal abnormality is selected from the group consisting of: a translocation, a deletion, a duplication, an inversion, an insertion, a ring, copy number variations, an indel, and an isochromosome. 363. The method of embodiment 354, wherein the cell is in a plurality of cells. 364. The method of embodiment 363, wherein the plurality of cells comprises a healthy cell. 365. The method of embodiment 364, wherein after the administering, the healthy cell lives. 366. The method of embodiment 364, wherein after the administering, the healthy cell proliferates. 367. The method of embodiment 354, wherien the cleaving comprises cleaving at one or more than one cleavage site in the cell. 368. The method of embodiment 355, wherein the disorder is cancer. 369. The method of embodiment 368, wherein the cancer comprises lung cancer or pancreatic cancer. 370. The method of embodiment 354, wherein the target nucleic acid comprises a single nucleotide polymorphism specific to a cancer, a translocation, or a sequence associated with cancer progression. 371. The method of embodiment 354, wherein the target nucleic acid comprises a portion of a gene selected from the group consisting of: BRCA-1, BRAF, BCR-ABL, HER2, KIF5A, IRX1, ADAMTS16, GNPDA2, KCNE2, SLC15A5, SMIM11, DACH2, HERC2P2, CD68SHBG, ERBB2, KRT16, LINC00536, TRPS1, CDK8, TRAPPC9, HERC2P2, SIRPB1, MRC1, ATP11A, POTEB, HERC2P2, PRDM9, CDKN2B, HPV, LINE2 (MT2), CCR5, or HPRT1. 372. The method of embodiment 354, wherein the chimeric polypeptide further comprises inducible non-specific nuclease activity. 373. The method of embodiment 372, wherein the inducible non-specific nuclease activity is activated by site-specific cleavage of the target nucleic acid by the chimeric polypeptide. 374. The method of embodiment 354, wherein the first domain comprises a Cas12a (or Cpf1) domain, a Cas12a domain, a Cas12b domain, a Cas12c domain, a Cas12d domain, a Cas12e domain, a Cas12f domain, a Cas12g domain, a Cas12h domain, a Cas12i domain, a Cas13a domain, a Cas13b domain, a Cas14 domain, or a Cas9 domain. 375. The method of embodiment 354, wherein the first domain comprises a Cas12a (or Cpf1) domain. 376. The method of embodiment 354, wherein the first domain comprises a Cas13a or Cas13b domain. 377. The method of embodiment 354, wherein the first domain comprises a Cas9 domain. 378. The method of embodiment 354, wherein the guide nucleic acid comprises a sequence selected from the group consisting of the sequences listed in Table 6 and paragraph [00303] or Table 7 and paragraph [00305]. 379. The method of embodiment 354, wherein the second domain comprises a RecE domain, a RecJ domain, a T5 domain, a Lambda Exonuclease domain, a RecBCD domain, a DNA pol I small fragment domain, an ExoI domain, an ExoII domain, an ExoVII domain, an Exo T domain, a Trex1 domain, or a Trex2 domain. 380. The method of embodiment 354, wherein the chimeric polypeptide generates a 3' OH overhang. 381. The method of embodiment 354, wherein the chimeric polypeptide exposes a recessed 3' OH. 382. The method of embodiment 354, wherein the second domain comprises an enzyme having cleaved end resection activity. 383. The method of embodiment 354, wherein the second domain comprises mung bean nuclease. 384. The method of embodiment 364, wherein the target nucleic acid is absent in a healthy cell of the subject.

EXAMPLES

Example 1. Exemplary Implementation in the Context of Cancer

An individual's tumor tissues are tested to determine whether or not an appropriate target is present. Using whole genomic sequence analysis of cancer specimens from patients, SNPs or other mutations that show the sufficient specificity compared with normal cells are identified.

Multiple gRNA molecules having complementary sequence to the cancer-specific SNPs are synthesized. These synthesized gRNAs recognize SNPs specifically in cancer cell in vivo and induce the activation of genome editing and non-specific nuclease activity of CRISPR PLUS™.

Cancer cell specific activation of genome editing and non-specific nuclease function of CRISPR PLUS™ are validated using target DNA cleavage and nuclease activity assay preliminary in ex vivo systems. A selected sets of pre-assembled gRNA and CRISPR PLUS™ (including CRISPR) protein complex is administered into the patient.

Through the administration of the selected sets of pre-assembled gRNA and CRISPR PLUS™, the CRISPR PLUS™-gRNA complexes enter the cells and screen the genomic DNA to detect complementary SNP sequences in the cells. In normal cells containing no SNP or other mutant sequence, the CRISPR PLUS™-gRNA complexes are not activated, and as a result, little or no targeted or untargeted cell nucleic acid degradation occurs. However, in cancer cells containing SNPs or other mutant sequences that are complementary to the gRNAs, the genome editing function is activated, and subsequently non-specific nuclease activity of the CRISPR PLUS™-gRNA complex is activated.

The activated genome editing function removes the nucleic acids harboring the cancer specific SNP or other mutation or mutant sequence. The activated non-specific nuclease function then degrades cellular double stranded and single stranded DNA/RNA molecules which in turn induce cell death in cancer specific manner (see FIG. 2).

The administration regimen may be followed by administration of a ribonucleoprotein complex such as a CRISPR or CRISPR PLUS™ terminator to remove the activity of CRISPR PLUS™-gRNA complex remaining in a subject's body. Then the anti-Cas antibody is subsequently administered to neutralize the effects of the CRISPR or CRISPR PLUS™ proteins. This termination process of CRISPR or CRISPR PLUS™-gRNA complex after completion of therapy minimizes any potential side effects caused by off-target activity of CRISPR or CRISPR PLUS™.

Example 2. Representative Cas9 Nucleic Acid and Protein

A number of CRISPR/Cas complexes are consistent with the disclosure herein. An exemplary Cas sequence, that of SpyCas9, is provided below in nucleotide and amino acid form.

```
>NC_002737.2:854751-858857 Streptococcus pyogenes M1 GAS
                                                    (SEQ ID NO: 67)
ATGGATAAGAAATACTCAATAGGCTTAGATATCGGCACAAATAGCGTCGGATGGGC

GGTGATCACTGATGAATATAAGGTTCCGTCTAAAAAGTTCAAGGTTCTGGGAAATACAGACCGCCA

CAGTATCAAAAAAAATCTTATAGGGGCTCTTTTATTTGACAGTGGAGAGACAGCGGAAGCGACTCG

TCTCAAACGGACAGCTCGTAGAAGGTATACACGTCGGAAGAATCGTATTTGTTATCTACAGGAGAT

TTTTTCAAATGAGATGGCGAAAGTAGATGATAGTTTCTTTCATCGACTTGAAGAGTCTTTTTTGGT

GGAAGAAGACAAGAAGCATGAACGTCATCCTATTTTTGGAAATATAGTAGATGAAGTTGCTTATCA

TGAGAAATATCCAACTATCTATCATCTGCGAAAAAAATTGGTAGATTCTACTGATAAAGCGGATTT

GCGCTTAATCTATTTGGCCTTAGCGCATATGATTAAGTTTCGTGGTCATTTTTGATTGAGGGAGA

TTTAAATCCTGATAATAGTGATGTGGACAAACTATTTATCCAGTTGGTACAAACCTACAATCAATT

ATTTGAAGAAAACCCTATTAACGCAAGTGGAGTAGATGCTAAAGCGATTCTTTCTGCACGATTGAG

TAAATCAAGACGATTAGAAAATCTCATTGCTCAGCTCCCCGGTGAGAAGAAAAATGGCTTATTTGG
```

-continued
```
GAATCTCATTGCTTTGTCATTGGGTTTGACCCCTAATTTTAAATCAAATTTTGATTTGGCAGAAGA
TGCTAAATTACAGCTTTCAAAAGATACTTACGATGATGATTTAGATAATTTATTGGCGCAAATTGG
AGATCAATATGCTGATTTGTTTTTGGCAGCTAAGAATTTATCAGATGCTATTTTACTTTCAGATAT
CCTAAGAGTAAATACTGAAATAACTAAGGCTCCCCTATCAGCTTCAATGATTAAACGCTACGATGA
ACATCATCAAGACTTGACTCTTTTAAAAGCTTTAGTTCGACAACAACTTCCAGAAAAGTATAAAGA
AATCTTTTTTGATCAATCAAAAAACGGATATGCAGGTTATATTGATGGGGGAGCTAGCCAAGAAGA
ATTTTATAAATTTATCAAACCAATTTTAGAAAAAATGGATGGTACTGAGGAATTATTGGTGAAACT
AAATCGTGAAGATTTGCTGCGCAAGCAACGGACCTTTGACAACGGCTCTATTCCCCATCAAATTCA
CTTGGGTGAGCTGCATGCTATTTTGAGAAGACAAGAAGACTTTTATCCATTTTTAAAAGACAATCG
TGAGAAGATTGAAAAAATCTTGACTTTTCGAATTCCTTATTATGTTGGTCCATTGGCGCGTGGCAA
TAGTCGTTTTGCATGGATGACTCGGAAGTCTGAAGAAACAATTACCCCATGGAATTTTGAAGAAGT
TGTCGATAAAGGTGCTTCAGCTCAATCATTTATTGAACGCATGACAAACTTTGATAAAAATCTTCC
AAATGAAAAAGTACTACCAAAACATAGTTTGCTTTATGAGTATTTTACGGTTTATAACGAATTGAC
AAAGGTCAAATATGTTACTGAAGGAATGCGAAAACCAGCATTTCTTTCAGGTGAACAGAAGAAAGC
CATTGTTGATTTACTCTTCAAAACAAATCGAAAAGTAACCGTTAAGCAATTAAAAGAAGATTATTT
CAAAAAAATAGAATGTTTTGATAGTGTTGAAATTTCAGGAGTTGAAGATAGATTTAATGCTTCATT
AGGTACCTACCATGATTTGCTAAAAATTATTAAAGATAAAGATTTTTTGGATAATGAAGAAAATGA
AGATATCTTAGAGGATATTGTTTTAACATTGACCTTATTTGAAGATAGGGAGATGATTGAGGAAAG
ACTTAAAACATATGCTCACCTCTTTGATGATAAGGTGATGAAACAGCTTAAACGTCGCCGTTATAC
TGGTTGGGGACGTTTGTCTCGAAAATTGATTAATGGTATTAGGGATAAGCAATCTGGCAAAACAAT
ATTAGATTTTTTGAAATCAGATGGTTTTGCCAATCGCAATTTATGCAGCTGATCCATGATGATAG
TTTGACATTTAAAGAAGACATTCAAAAAGCACAAGTGTCTGGACAAGGCGATAGTTTACATGAACA
TATTGCAAATTTAGCTGGTAGCCCTGCTATTAAAAAAGGTATTTTACAGACTGTAAAAGTTGTTGA
TGAATTGGTCAAAGTAATGGGGCGGCATAAGCCAGAAAATATCGTTATTGAAATGGCACGTGAAAA
TCAGACAACTCAAAAGGGCCAGAAAAATTCGCGAGAGCGTATGAAACGAATCGAAGAAGGTATCAA
AGAATTAGGAAGTCAGATTCTTAAAGAGCATCCTGTTGAAAATACTCAATTGCAAAATGAAAAGCT
CTATCTCTATTATCTCCAAAATGGAAGAGACATGTATGTGGACCAAGAATTAGATATTAATCGTTT
AAGTGATTATGATGTCGATCACATTGTTCCACAAAGTTTCCTTAAAGACGATTCAATAGACAATAA
GGTCTTAACGCGTTCTGATAAAAATCGTGGTAAATCGGATAACGTTCCAAGTGAAGAAGTAGTCAA
AAAGATGAAAAACTATTGGAGACAACTTCTAAACGCCAAGTTAATCACTCAACGTAAGTTTGATAA
TTTAACGAAAGCTGAACGTGGAGGTTTGAGTGAACTTGATAAAGCTGGTTTTATCAAACGCCAATT
GGTTGAAACTCGCCAAATCACTAAGCATGTGGCACAAATTTTGGATAGTCGCATGAATACTAAATA
CGATGAAAATGATAAACTTATTCGAGAGGTTAAAGTGATTACCTTAAAATCTAAATTAGTTTCTGA
CTTCCGAAAAGATTTCCAATTCTATAAAGTACGTGAGATTAACAATTACCATCATGCCCATGATGC
GTATCTAAATGCCGTCGTTGGAACTGCTTTGATTAAGAAATATCCAAAACTTGAATCGGAGTTTGT
CTATGGTGATTATAAAGTTTATGATGTTCGTAAAATGATTGCTAAGTCTGAGCAAGAAATAGGCAA
AGCAACCGCAAAATATTTCTTTTACTCTAATATCATGAACTTCTTCAAAACAGAAATTACACTTGC
AAATGGAGAGATTCGCAAACGCCCTCTAATCGAAACTAATGGGGAAACTGGAGAAATTGTCTGGGA
TAAAGGGCGAGATTTTGCCACAGTGCGCAAAGTATTGTCCATGCCCCAAGTCAATATTGTCAAGAA
AACAGAAGTACAGACAGGCGGATTCTCCAAGGAGTCAATTTTACCAAAAAGAAATTCGGACAAGCT
TATTGCTCGTAAAAAAGACTGGGATCCAAAAAAATATGGTGGTTTTGATAGTCCAACGGTAGCTTA
```

-continued

```
TTCAGTCCTAGTGGTTGCTAAGGTGGAAAAAGGGAAATCGAAGAAGTTAAAATCCGTTAAAGAGTT

ACTAGGGATCACAATTATGGAAAGAAGTTCCTTTGAAAAAAATCCGATTGACTTTTTAGAAGCTAA

AGGATATAAGGAAGTTAAAAAAGACTTAATCATTAAACTACCTAAATATAGTCTTTTTGAGTTAGA

AAACGGTCGTAAACGGATGCTGGCTAGTGCCGGAGAATTACAAAAAGGAAATGAGCTGGCTCTGCC

AAGCAAATATGTGAATTTTTTATATTTAGCTAGTCATTATGAAAAGTTGAAGGGTAGTCCAGAAGA

TAACGAACAAAAACAATTGTTTGTGGAGCAGCATAAGCATTATTTAGATGAGATTATTGAGCAAAT

CAGTGAATTTTCTAAGCGTGTTATTTTAGCAGATGCCAATTTAGATAAAGTTCTTAGTGCATATAA

CAAACATAGAGACAAACCAATACGTGAACAAGCAGAAAATATTATTCATTTATTTACGTTGACGAA

TCTTGGAGCTCCCGCTGCTTTTAAATATTTTGATACAACAATTGATCGTAAACGATATACGTCTAC

AAAAGAAGTTTTAGATGCCACTCTTATCCATCAATCCATCACTGGTCTTTATGAAACACGCATTGA

TTTGAGTCAGCTAGGAGGTGACTGA
```

>SpyCas9 protein
(SEQ ID NO: 68)

```
MIKFRGHFLIEGDLNPDNSDVDKLFIQLVQTYNQLFEENPINASGVDAKAILSARL

SKSRRLENLIAQLPGEKKNGLFGNLIALSLGLTPNFKSNFDLAEDAKLQLSKDTYDDDLDNLLAQI

GDQYADLFLAAKNLSDAILLSDILRVNTEITKAPLSASMIKRYDEHHQDLTLLKALVRQQLPEKYK

EIFFDQSKNGYAGYIDGGASQEEFYKFIKPILEKMDGTEELLVKLNREDLLRKQRTFDNGSIPHQI

HLGELHAILRRQEDFYPFLKDNREKIEKILTFRIPYYVGPLARGNSRFAWMTRKSEETITPWNFEE

VVDKGASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGIRDKQSGKT

ILDFLKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQLQNEK

LYLYYLQNGRDMYVDQELDINRLSDYDVDHIVPQSFLKDDSIDNKVLTRSDKNRGKSDNVPSEEVV

KKMKNYWRQLLNAKLITQRKFDNLTKAERGGLSELDKAGFIKRQLVETRQITKHVAQILDSRMNTK

YDENDKLIREVKVITLKSKLVSDFRKDFQFYKVREINNYHHAHDAYLNAVVGTALIKKYPKLESEF

VYGDYKVYDVRKMIAKSEQEIGKATAKYFFYSNIMNFFKTEITLANGEIRKRPLIETNGETGEIVW

DKGRDFATVRKVLSMPQVNIVKKTEVQTGGFSKESILPKRNSDKLIARKKDWDPKKYGGFDSPTVA

YSVLVVAKVEKGKSKKLKSVKELLGITIMERSSFEKNPIDFLEAKGYKEVKKDLIIKLPKYSLFEL

ENGRKRMLASAGELQKGNELALPSKYVNFLYLASHYEKLKGSPEDNEQKQLFVEQHKHYLDEIIEQ

ISEFSKRVILADANLDKVLSAYNKHRDKPIREQAENIIHLFTLINLGAPAAFKYFDTTIDRKRYTS

TKEVLDATLIHQSITGLYETRIDLSQLGGD
```

Example 3. Representative alternative to Cas9-FnCpf1 nucleic acid and protein An exemplary Cas alternative, Cpf1, is provided below in nucleotide and amino acid form.

>FnCpf1, NCBIaccessionno.CP009633.1
(SEQ ID NO: 69)

```
ATGTCAATTTATCAAGAATTTGTTAATAAATATAGTTTAAGTAAAACTCTAAGATT

TGAGTTAATCCCACAGGGTAAAACACTTGAAAACATAAAAGCAAGAGGTTTGATTTTAGATGATGA

GAAAAGAGCTAAAGACTACAAAAAGGCTAAACAAATAATTGATAAATATCATCAGTTTTTTATAGA

GGAGATATTAAGTTCGGTTTGTATTAGCGAAGATTTATTACAAAACTATTCTGATGTTTATTTAA
```

-continued

```
ACTTAAAAAGAGTGATGATGATAATCTACAAAAAGATTTTAAAAGTGCAAAAGATACGATAAAGAA
ACAAATATCTGAATATATAAAGGACTCAGAGAAATTTAAGAATTTGTTTAATCAAAACCTTATCGA
TGCTAAAAAAGGGCAAGAGTCAGATTTAATTCTATGGCTAAAGCAATCTAAGGATAATGGTATAGA
ACTATTTAAAGCCAATAGTGATATCACAGATATAGATGAGGCGTTAGAAATAATCAAATCTTTTAA
AGGTTGGACAACTTATTTTAAGGGTTTTCATGAAAATAGAAAAAATGTTTATAGTAGCAATGATAT
TCCTACATCTATTATTTATAGGATAGTAGATGATAATTTGCCTAAATTTCTAGAAAATAAAGCTAA
GTATGAGAGTTTAAAAGACAAAGCTCCAGAAGCTATAAACTATGAACAAATTAAAAAGATTTGGC
AGAAGAGCTAACCTTTGATATTGACTACAAAACATCTGAAGTTAATCAAAGAGTTTTTTCACTTGA
TGAAGTTTTTGAGATAGCAAACTTTAATAATTATCTAAATCAAAGTGGTATTACTAAATTTAATAC
TATTATTGGTGGTAAATTTGTAAATGGTGAAAATACAAAGAGAAAAGGTATAAATGAATATATAAA
TCTATACTCACAGCAAATAAATGATAAAACACTCAAAAAATATAAAATGAGTGTTTTATTTAAGCA
AATTTTAAGTGATACAGAATCTAAATCTTTTGTAATTGATAAGTTAGAAGATGATAGTGATGTAGT
TACAACGATGCAAAGTTTTTATGAGCAAATAGCAGCTTTTAAAACAGTAGAAGAAAATCTATTAA
AGAAACACTATCTTTATTATTTGATGATTTAAAAGCTCAAAAACTTGATTTGAGTAAAATTTATTT
TAAAAATGATAAATCTCTTACTGATCTATCACAACAAGTTTTTGATGATTATAGTGTTATTGGTAC
AGCGGTACTAGAATATATAACTCAACAAATAGCACCTAAAAATCTTGATAACCCTAGTAAGAAAGA
GCAAGAATTAATAGCCAAAAAAACTGAAAAAGCAAATACTTATCTCTAGAAACTATAAAGCTTGC
CTTAGAAGAATTTAATAAGCATAGAGATATAGATAAACAGTGTAGGTTTGAAGAAATACTTGCAAA
CTTTGCGGCTATTCCGATGATATTTGATGAAATAGCTCAAAACAAAGACAATTTGGCACAGATATC
TATCAAATATCAAAATCAAGGTAAAAAAGACCTACTTCAAGCTAGTGCGGAAGATGATGTTAAAGC
TATCAAGGATCTTTTAGATCAAACTAATAATCTCTTACATAAACTAAAAATATTTCATATTAGTCA
GTCAGAAGATAAGGCAAATATTTTAGACAAGGATGAGCATTTTTATCTAGTATTTGAGGAGTGCTA
CTTTGAGCTAGCGAATATAGTGCCTCTTTATAACAAAATTAGAAACTATATAACTCAAAAGCCATA
TAGTGATGAGAAATTTAAGCTCAATTTTGAGAACTCGACTTTGGCTAATGGTTGGGATAAAAATAA
AGAGCCTGACAATACGGCAATTTTATTTATCAAAGATGATAAATATTATCTGGGTGTGATGAATAA
GAAAATAACAAAATATTTGATGATAAAGCTATCAAAGAAAATAAAGGCGAGGGTTATAAAAAAAT
TGTTTATAAACTTTTACCTGGCGCAAATAAAATGTTACCTAAGGTTTTCTTTTCTGCTAAATCTAT
AAAATTTTATAATCCTAGTGAAGATATACTTAGAATAAGAAATCATTCCACACATACAAAAAATGG
TAGTCCTCAAAAAGGATATGAAAAATTTGAGTTTAATATTGAAGATTGCCGAAAATTTATAGATTT
TTATAAACAGTCTATAAGTAAGCATCCGGAGTGGAAAGATTTTGGATTTAGATTTTCTGATACTCA
AAGATATAATTCTATAGATGAATTTTATAGAGAAGTTGAAAATCAAGGCTACAAACTAACTTTTGA
AAATATATCAGAGAGCTATATTGATAGCGTAGTTAATCAGGGTAAATTGTACCTATTCCAAATCTA
TAATAAAGATTTTTCAGCTTATAGCAAAGGGCGACCAAATCTACATACTTTATATTGGAAAGCGCT
GT1TGA1GAGAGAAATCTTCAAGATGTGGTTTATAAGCTAAATGGTGAGGCAGAGCTTTTTTATCG
TAAACAATCAATACCTAAAAAAATCACTCACCCAGCTAAAGAGGCAATAGCTAATAAAAACAAAGA
TAATCCTAAAAAAGAGAGTGTTTTTGAATATGATTTAATCAAAGATAAACGCTTTACTGAAGATAA
GTTTTTCTTCACTGTCCTATTACAATCAATTTTAAATCTAGTGGAGCTAATAAGTTTAATGATGA
AATCAATTTATTGCTAAAAGAAAAAGCAAATGATGTTCATATATTAAGTATAGATAGAGGTGAAAG
ACATTTAGCTTACTATACTTTGGTAGATGGTAAAGGCAATATCATCAAACAAGATACTTTCAACAT
CATTGGTAATGATAGAATGAAAACAAACTACCATGATAAGCTTGCTGCAATAGAGAAAGATAGGGA
```

-continued

```
TTCAGCTAGGAAAGACTGGAAAAAGATAAATAACATCAAAGAGATGAAAGAGGGCTATCTATCTCA

GGTAGTTCATGAAATAGCTAAGCTAGTTATAGAGTATAATGCTATTGTGGTTTTTGAGGATTTAAA

TTTTGGATTTAAAAGAGGGCGTTTCAAGGTAGAGAAGCAGGTCTATCAAAAGTTAGAAAAAATGCT

AATTGAGAAACTAAACTATCTAGTTTTCAAAGATAATGAGTTTGATAAAACTGGGGGAGTGCTTAG

AGCTTATCAGCTAACAGCACCTTTTGAGACTTTTAAAAAGATGGGTAAACAAACAGGTATTATCTA

CTATGTACCAGCTGGTTTTACTTCAAAAATTTGTCCTGTAACTGGTTTTGTAAATCAGTTATATCC

TAAGTATGAAAGTGTCAGCAAATCTCAAGAGTTCTTTAGTAAGTTTGACAAGATTTGTTATAACCT

TGATAAGGGCTATTTTGAGTTTAGTTTTGATTATAAAAACTTTGGTGACAAGGCTGCCAAAGGCAA

GTGGACTATAGCTAGCTTTGGGAGTAGATTGATTAACTTTAGAAATTCAGATAAAAATCATAATTG

GGATACTCGAGAAGTTTATCCAACTAAAGAGTTGGAGAAATTGCTAAAAGATTATTCTATCGAATA

TGGGCATGGCGAATGTATCAAAGCAGCTATTTGCGGTGAGAGCGACAAAAAGTTTTTTGCTAAGCT

AACTAGTGTCCTAAATACTATCTTACAAATGCGTAACTCAAAAACAGGTACTGAGTTAGATTATCT

AATTTCACCAGTAGCAGATGTAAATGGCAATTTCTTTGATTCGCGACAGGCGCCAAAAAATATGCC

TCAAGATGCTGATGCCAATGGTGCTTATCATATTGGGCTAAAAGGTCTGATGCTACTAGGTAGGAT

CAAAAATAATCAAGAGGGCAAAAAACTCAATTTGGTTATCAAAAATGAAGAGTATTTTGAGTTCGT

GCAGAATAGGAATAACTAA
```

>FnCpf1, NCBIaccessionno.CP009633.1 protein sequence (SEQ ID NO: 70)

```
MSIYQEFVNKYSLSKTLRFELIPQGKTLENIKARGLILDDEKRAKDYKKAKQIIDK

YHQFFIEEILSSVCISEDLLQNYSDVYFKLKKSDDDNLQKDFKSAKDTIKKQISEYIKDSEKFKNL

FNQNLIDAKKGQESDLILWLKQSKDNGIELFKANSDITDIDEALEIIKSFKGWITYFKGFHENRKN

VYSSNDIPTSIIYRIVDDNLPKFLENKAKYESLKDKAPEAINYEQIKKDLAEELTFDIDYKTSEVN

QRVFSLDEVFEIANFNNYLNQSGITKFNIIGGKFVNGENTKRKGINEYINLYSQQINDKILKKYK

MSVLFKQILSDIESKSFVIDKLEDDSDVVITMQSFYEQIAAFKIVEEKSIKETLSLLFDDLKAQKL

DLSKIYFKNDKSLIDLSQQVFDDYSVIGTAVLEYITQQIAPKNLDNPSKKEQELIAKKTEKAKYLS

LETIKLALEEFNKHRDIDKQCRFEEILANFAAIPMIFDEIAQNKDNLAQISIKYQNQGKKDLLQAS

AEDDVKAIKDLLDQINNLLHKLKIFHISQSEDKANILDKDEHFYLVFEECYFELANIVPLYNKIRN

YITQKPYSDEKFKLNFENSTLANGWDKNKEPDNTAILFIKDDKYYLGVMNKKNNKIFDDKAIKENK

GEGYKKIVYKLLPGANKMLPKVFFSAKSIKFYNPSEDILRIRNHSTHIKNGSPQKGYEKFEFNIED

CRKFIDFYKQSISKHPEWKDFGFRFSDIQRYNSIDEFYREVENQGYKLIFENISESYIDSVVNQGK

LYLFQIYNKDFSAYSKGRPNLHTLYWKALFDERNLQDVVYKLNGEAELFYRKQSIPKKITHPAKEA

IANKNKDNPKKESVFEYDLIKDKRFTEDKFFFHCPITINFKSSGANKFNDEINLLLKEKANDVHIL

SIDRGERHLAYYTLVDGKGNIIKQDTFNIIGNDRMKTNYHDKLAAIEKDRDSARKDWKKINNIKEM

KEGYLSQVVHEIAKLVIEYNAIVVFEDLNFGFKRGRFKVEKQVYQKLEKMLIEKLNYLVFKDNEFD

KIGGVLRAYQLTAPFETFKKMGKQTGIIYYVPAGFTSKICPVTGFVNQLYPKYESVSKSQEFFSKF

DKICYNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKIGTELDYLISPVADVNGNFFDSR

QAPKNMPQDADANGAYHIGLKGLMLLGRIKNNQEGKKLNLVIKNEEYFEFVQNRNN
```

Example 4. Exonucleases Used in Various
Ribonucleoprotein Nuclease Complexes

A number of exonucleases are consistent with the disclosure herein. A partial listing of exonucleases is provided below, although others are also consistent with the disclosure herein.

```
>Exoribonuclease T
                                              (SEQ ID NO: 71)
MSDNAQLTGLCDRFRGFYPVVIDVETAGFNAKTDALLEIAAITLKMDEQGWLMPDTTLHFHVEPFV

GANLQPEALAFNGIDPNDPDRGAVSEYEALHEIFKVVRKGIKASGCNRAIMVAHNANFDHSFMMAA

AERASLKRNPFHPFATFDTAALAGLALGQTVLSKACQTAGMDFDSTQAHSALYDTERTAVLFCEIV

NRWKRLGGWPLSAAEEV

>TREX2
                                              (SEQ ID NO: 72)
MSEAPRAETFVFLDLEATGLPSVEPEIAELSLFAVHRSSLENPEHDESGALVLPRVLDKLTLCMCP

ERPFTAKASEITGLSSEGLARCRKAGFDGAVVRTLQAFLSRQAGPICLVAHNGFDYDFPLLCAELR

RLGARLPRDTVCLDTLPALRGLDRAHSHGTRARGRQGYSLGSLFHRYFRAEPSAAHSAEGDVHTLL

LIFLHRAAELLAWADEQARGWAHIEPMYLPPDDPSLEA

>TREX1
                                              {SEQ ID NO: 73)
MQTLIFFDMEATGLPFSQPKVTELCLLAVHRCALESPPTSQGPPPTVPPPPRVVDKLSLCVAPGKA

CSPAASEITGLSTAVLAAHGRQCFDDNLANLLLAFLRRQPQPWCLVAHNGDRYDFPLLQAELAMLG

LTSALDGAFCVDSITALKALERASSPSEHGPRKSYSLGSIYTRLYGQSPPDSHTAEGDVLALLSIC

QWRPQALLRWVDAHARPFGTIRPMYGVTASARTKPRPSAVTTTAHLATTRNTSPSLRESRGTKDLP

PVKDPGALSREGLLAPLGLLAILTLAVATLYGLSLATPGD

>RecBCD_RecB
                                              (SEQ ID NO: 74)
MSDVAETLDPLRLPLQGERLIEASAGTGKTFTIAALYLRLLLGLGGSAAFPRPLTVEELLVVTFTE

AATAELRGRIRSNIHELRIACLRETTDNPLYERLLEEIDDKAQAAQWLLLAERQMDEAAVFTIHGF

CQRMLNLNAFESGMLFEQQLIEDESLLRYQACADFWRRHCYPLPREIAQVVFETWKGPQALLRDIN

RYLQGEAPVIKAPPPDDETLASRHAQIVARIDTVKQQWRDAVGELDALIESSGIDRRKFNRSNQAK

WIDKISAWAEEETNSYQLPESLEKFSQRFLEDRIKAGGETPRHPLFEAIDQLLAEPLSIRDLVITR

ALAEIRETVAREKRRRGELGFDDMLSRLDSALRSESGEVLAAAIRTRFPVAMIDEFQDTDPQQYRI

FRRIWHHQPETALLLIGDPKQAIYAFRGADIFTYMKARSEVHAHYTLDTNWRSAPGMVNSVNKLFS

QTDDAFMFREIPFIPVKSAGKNQALRFVFKGETQPAMKMWLMEGESCGVGDYQSTMAQVCAAQIRD

WLQAGQRGEALLMNGDDARPVRASDISVLVRSRQEAAQVRDALTLLEIPSVYLSNRDSVFETLEAQ

EMLWLLQAVMTPERENTLRSALATSMMGLNALDIETLNNDEHAWDVVVEEFDGYRQIWRKRGVMPM

LRALMSARNIAENLLATAGGERRLTDILHISELLQEAGTQLESEHALVRWLSQHILEPDSNASSQQ

MRLESDKHLVQIVTIHKSKGLEYPLVWLPFITNFRVQEQAFYHDRHSFEAVLDLNAAPESVDLAEA

ERLAEDLRLLYVALTRSVWHCSLGVAPLVRRRGDKKGDTDVHQSALGRLLQKGEPQDAAGLRTCIE

ALCDDDIAWQTAQTGDNQPWQVNDVSTAELNAKTLQRLPGDNWRVTSYSGLQQRGHGIAQDLMPRL

DVDAAGVASVVEEPTLTPHQFPRGASPGTFLHSLFEDLDFTQPVDPNWVREKLELGGFESQWEPVL

TEWITAVLQAPLNETGVSLSQLSARNKQVEMEFYLPISEPLIASQLDTLIRQFDPLSAGCPPLEFM

QVRGMLKGFIDLVFRHEGRYYLLDYKSNWLGEDSSAYTQQAMAAAMQAHRYDLQYQLYTLALHRYL

RHRIADYDYEHHFGGVIYLFLRGVDKEHPQQGIYTTRPNAGLIALMDEMFAGMTLEEA
```

>RecBCD_RecC (SEQ ID NO: 75)

MLRVYHSNRLDVLEALMEFIVERERLDDPFEPEMILVQSTGMAQWLQMTLSQKFGIAANIDFPLPA

SFIWDMPVRVLPEIPKESAFNKQSMSWKLMILLPQLLEREDFILLRHYLTDDSDKRKLFQLSSKAA

DLFDQYLVYRPDWLAQWEIGHLVEGLGEAQAWQAPLWKALVEYTHQLGQPRWHRANLYQRFIETLE

SATTCPPGLPSRVFICGISALPPVYLQALQALGKHIEIHLLFTNPCRYYWGDIKDPAYLAKLLTRQ

RRHSFEDRELPLFRDSENAGQLFNSDGEQDVGNPLLASWGKLGRDYIYLLSDLESSQELDAFVDVT

PDNLLHNIQSDILELENRAVAGVNIEEFSRSDNKRPLDPLDSSITFHVCHSPQREVEVLHDRLLAM

LEEDPTLTPRDIIVMVADIDSYSPFIQAVFGSAPADRYLPYAISDRRARQSHPVLEAFISLLSLPD

SRFVSEDVLALLDVPVLAARFDITEEGLRYLRQWVNESGIRWGIDDDNVRELELPATGQHTWRFGL

TRMLLGYAMESAQGEWQSVLPYDESSGLIAELVGHLASLLMQLNIWRRGLAQERPLEEWLPVCRDM

LNAFFLPDAETEAAMTLIEQQWQAIIAEGLGAQYGDAVPLSLLRDELAQRLDQERISQRFLAGPVN

ICILMPMRSIPFKVVCLLGMNDGVYPRQLAPLGFDLMSQKPKRGDRSRRDDDRYLFLEALISAQQK

LYISYIGRSIQDNSERFPSVLVQELIDYIGQSHYLPGDEALNCDESEARVKAHLTCLHIRMPFDPQ

NYQPGERQSYAREWLPAASQAGKAHSEPVQPLPFTLPETVPLETLQRFWAHPVRAFFQMRLQVNFR

TEDSEIPDTEPFILEGLSRYQINQQLLNALVEQDDAERLFRRFRAAGDLPYGAFGEIFWETQCQEM

QQLADRVIACRQPGQSMEIDLACNGVQITGWLPQVQPDGLLRWRPSLLSVAQGMQLWLEHLVYCAS

GGNGESRLFLRKDGEWRFPPLAAEQALHYLSQLIEGYREGMSAPLLVLPESGGAWLKTCYDAQNDA

MLDDDSTLQKARTKFLQAYEGNMMVRGEGDDIWYQRLWRQLTPETMEAIVEQSQRFLLPLFRFNQS

>RecBCD_RecD (SEQ ID NO: 76)

MKLQKQLLEAVEHKQLRPLDVQFALTVAGDEHPAVTLAAALLSHDAGEGHVCLPLSRLENNEASHP

LLATCVSEIGELQNWEECLLASQAVSRGDEPTPMILCGDRLYLNRMWCNERTVARFFNEVNHAIEV

DEALLAQILDKLFPVSDEINWQKVAAAVALTRRISVISGGPGIGKITIVAKLLAALIQMADGERCR

IRLAAPIGKAAARLTESLGKALRQLPLIDEQKKRIPEDASTLHRLLGAQPGSQRLRHHAGNPLHLD

VLVVDEASMIDLPMMSRLIDALPDHARVIFLGDRDQLASVEAGAVLGDICAYANAGFTAERARQLS

RLIGTHVPAGIGTEAASLRDSLCLLQKSYRFGSDSGIGQLAAAINRGDKTAVKIVFQQDFIDIEKR

LLQSGEDYIAMLEEALAGYGRYLDLLQARAEPDLIIQAFNEYQLLCALREGPFGVAGLNERIEQFM

QQKRKIHRHPHSRWYEGRPVMIARNDSALGLFNGDIGIALDRGQGTRVWFAMPDGNIKSVQPSRLP

EHETTWAMTVHKSQGSEFDHAALILPSQRTPVVIRELVYTAVTRARRRLSLYADERILSAAIATRT

ERRSGLAALFSSRE

>Exodeoxyribonuclease I (SEQ ID NO: 77)

MMNDGKQQSTFLFHDYETFGTHPALDRPAQFAAIRTDSEFNVIGEPEVFYCKPADDYLPQPGAVLI

TGITPQEARAKGENEAAFAARIHSLFTVPKICILGYNNVRFDDEVIRNIFYRNFYDPYAWSWQHDN

SRWDLLDVMRACYALRPEGINWPENDDGLPSFRLEHLTKANGIEHSNAHDAMADVYATIAMAKLVK

TRQPRLFDYLFTHRNKHKLMALIDVPQMKPLVHVSGMFGAWRGNTSWVAPLAWHPENRNAVIMVDL

AGDISPLLELDSDILRERLYTAKIDLGDNAAVPVKLVHINKCPVLAQANTLRPEDADRLGINRQHC

LDNLKILRENPQVREKVVAIFAEAEPFTPSDNVDAQLYNGFFSDADRAAMKIVLETEPRNLPALDI

TFVDKRIEKLLFNYRARNFPGILDYAEQQRWLEHRRQVFTPEFLQGYADELQMLVQQYADDKEKVA

LLKALWQYAEEIV

>Exodeoxyribonuclease III
(SEQ ID NO: 78)
MKFVSFNINGLRARPHQLEAIVEKHQPDVIGLQETKVHDDMFPLEEVAKLGYNVFYHGQKGHYGVA

LLIKETPIAVRRGFPGDDEEAQRRIIMAEIPSLLGNVIVINGYFPQGESRDHPIKFPAKAQFYQNL

QNYLETELKRDNPVLIMGDMNISPIDLDIGIGEENRKRWLRIGKCSFLPEEREWMDRLMSWGLVDT

FRHANPQTADRFSWFDYRSKGFDDNRGLRIDLLLASQPLAECCVETGIDYEIRSMEKPSDHAPVWA

TFRR

>Mungbean exonuclease
(SEQ ID NO: 79)
MQTLQMSLLTQPYVQPRFPCKRYPIFSASCRIQKTAITKTEKVFFSESFDQTRCTQPLSEKKKRVF

FLDVNPLCYEGSKPSLRSFGRWLSLFLHQVSLTDPVIAVIDGEGGSEHRRKLLPSYKAHRKKFMRH

MSSGHVGRSHQVINDVLGKCNVPVIKVAGHEADDVVATLAGQVVNKGFRVVIGSPDKDFKQLISED

VQIVMPLPELQRWSFYILRHYRDQYNCDPESDLSFRCIVGDEVDGVPGIQHLVPSFGRKTAMKLIK

KHGSLEILLNAAAIRTVGRPYAQDALKNHADYLRRNYEVLALKRDVNIQLYDEWLVKRDNHNDKTA

LSSFFKYLGESKELSYNGRPISYNG

>RecJ
(SEQ ID NO: 80)
VKQQIQLRRREVDETADLPAELPPLLRRLYASRGVRSAQELERSVKGMLPWQQLSGVEKAVEILYN

AFREGTRIIVVGDFDADGATSTALSVLAMRSLGCSNIDYLVPNRFEDGYGLSPEVVDQAHARGAQL

IVIVDNGISSHAGVEHARSLGIPVIVIDHHLPGDILPAAEAIINPNLRDCNFPSKSLAGVGVAFYL

MLALRTFLRDQGWFDERNIAIPNLAELLDLVALGTVADVVPLDANNRILTWQGMSRIRAGKCRPGI

KALLEVANRDAQKLAASDLGFALGPRLNAAGRLDDMSVGVALLLCDNIGEARVLANELDALNQTRK

EIEQGMQIEALTLCEKLERSRDTLPGGLAMYHPEWHQGVVGILASRIKERFHRPVIAFAPAGDGIL

KGSGRSIQGLHMRDALERLDTLYPGMMLKFGGHAMAAGLSLEEDKFKLFQQRFGELVIEWLDPSLL

QGEVVSDGPLSPAEMTMEVAQLLRDAGPWGQMFPEPLFDGHFRLLQQRLVGERHLKVMVEPVGGGP

LLDGIAFNVDTALWPDNGVREVQLAYKLDINEFRGNRSLQIIIDNIWPI

>RecE
(SEQ ID NO: 81)
MSTKPLFLLRKAKKSSGEPDVVLWASNDFESTCATLDYLIVKSGKKLSSYFKAVAINFPVVNDLPA

EGEIDFTWSERYQLSKDSMTWELKPGAAPDNAHYQGNINVNGEDMTEIEENMLLPISGQELPIRWL

AQHGSEKPVTHVSRDGLQALHIARAEELPAVTALAVSHKISLLDPLEIRELHKLVRDTDKVFPNPG

NSNLGLITAFFEAYLNADYTDRGLLIKEWMKGNRVSHITRTASGANAGGGNLTDRGEGFVHDLTSL

ARDVATGVLARSMDLDIYNLHPAHAKRIEEIIAENKPPFSVFRDKFITMPGGLDYSRAIVVASVKE

APIGIEVIPAHVIEYLNKVLIETDHANPDPEIVDIACGRSSAPMPQRVIEEGKQDDEEKPQPSGIT

AVEQGEAETMEPDATEHHQDTQPLDAQSQVNSVDAKYQELRAELHEARKNIPSKNPVDDDKLLAAS

RGEFVDGISDPNDPKWVKGIQTRDCVYQNQPETEKTSPDMNQPEPVVQQEPEIACNACGQIGGDNC

PDCGAVMGDATYQETFDEESQVEAKENDPEEMEGAEHPHNENAGSDPHRDCSDETGEVADPVIVED

IEPGIYYGISNENYHAGPGISKSQLDDIADTPALYLWRKNAPVDTIKTKILDLGTAFHCRVLEPEE

FSNRFIVAPEFNRRINAGKEEEKAFLMECASIGKIVITAEEGRKIELMYQSVMALPLGQWLVESAG

HAESSIYWEDPETGILCRCRPDKIIPEFHWIMDVKITADIQRFKTAYYDYRYHVQDAFYSDGYEAQ

FGVQPIFVFLVASTTIECGRYPVEIFMMGEEAKLAGQQEYHRNLRILSDCLNIDEWPAIKILSLPR

WAKEYAND

```
>T5
                                                    (SEQ ID NO: 82)
MASRRNLMIVDGINLGFRFKHNNSKKPFASSYVSTIQSLAKSYSARTTIVLGDKGKSVFRLEHLPE

YKGNRDEKYAQRTEEEKALDEQFFEYLKDAFELCKTIFPIFTIRGVEADDMAAYIVKLIGHLYDHV

WLISIDGDWDILLTDKVSRFSFITRREYHLRDMYEHHNVDDVEQFISLKAIMGDLGDNIRGVEGIG

AKRGYNIIREFGNVLDIIDQLPLPGKQKYIQNLNASEELLFRNLILVDLPTYCVDAIAAVGQDVLD

KFTKDILEIAEQ

>Lambda exonuclease
                                                    (SEQ ID NO: 83)
MTPDIILQRTGIDVRAVEQGDDAWHKLRLGVITASEVHNVIAKPRSGKKWPDMKMSYFHILLAEVC

TGVAPEVNAKALAWGKQYENDARTLFEFTSGVNVIESPIIYRDESMRTACSPDGLCSDGNGLELKC

PFTSRDFMKFRLGGFEAIKSAYMAQVQYSMWVIRKNAWYFANYDPRMKREGLHYVVIERDEKYMAS

FDEIVPEFIEKMDEALAEIGFVFGEQWR

>Exonuclease VII small unit
                                                    (SEQ ID NO: 84)
MPKKNEAPASFEKALSELEQIVIRLESGDLPLEEALNEFERGVQLARQGQAKLQQAEQRVQILLSD

NEDASLTPFTPDNE

>Exonuclease VII large unit
                                                    (SEQ ID NO: 85)
MLPSQSPAIFTVSRLNQTVRLLLEHEMGQVWISGEISNFTQPASGHWYFILKDDTAQVRCAMFRNS

NRRVTFRPQHGQQVLVRANITLYEPRGDYQIIVESMQPAGEGLLQQKYEQLKAKLQAEGLFDQQYK

KPLPSPAHCVGVITSKTGAALHDILHVLKRRDPSLPVIIYPAAVQGDDAPGQIVRAIELANQRNEC

DVLIVGRGGGSLEDLWSFNDERVARAIFTSRIPVVSAVGHETDVTIADFVADLRAPTPSAAAEVVS

RNQQELLRQVQSTRQRLEMAMDYYLANRIRRFTQIHHRLQQQHPQLRLARQQTMLERLQKRMSFAL

ENQLKRTGQQQQRLIQRLNQQNPQPKIHRAQTRIQQLEYRLAETLRAQLSATRERFGNAVTHLEAV

SPLSTLARGYSVITAIDGNVLKKVKQVKAGEMLITRLEDGWIESEVKNIQPVKKSRKKVH
```

Example 5. In Vitro Ribonucleoprotein Specificity Assays

CRISPR/Cas12a nuclease complexes were assembled around a DHCR7 nucleic acid guide. Activity was assayed against DNA #1, comprising target sequence, and DNA #2, a non-target control. Output is measured by gel electrophoresis to assay for endonucleolytic activity, evidenced by presence of the 'cleaved DNA #1' band, and exonuclease activity, evidenced by band absence. Activity is assayed at 1.5 hours (top) and 24 hours (bottom) of FIG. 3.

Viewing the results from the left, one sees a DNA ladder followed by a nucleic acid control having only DNA #1 and DNA #2. At lane 3 one sees an assembled ribonucleoprotein complex with substrate indicating activity. At 1.5 hours endonucleolytic activity is apparent by the presence of the DNA #1 cleaved band, while at 24 hours a combination of endonucleolytic and exonucleolytic activity has eliminated both the cleaved and uncleaved DNA #1 bands. Lane 4 indicates that no off-target endonuclease or exonuclease activity occurs in the absence of an assembled complex having a guide RNA that has been activated by an active target sequence molecule, in this case DNA #1. Lane 5 indicates that no off-target endonuclease or exonuclease activity occurs in the presence of unassembled complex. At lane 6, one sees that activated complexes exhibit nonspecific nuclease activity at 24 hours but not at 1.5 hours. Lane 7 indicates that complexes lacking a guide RNA do not exhibit exonuclease activity.

These results indicate the benefit of having both sequence specificity and temporal specificity in CRISPR/Cas ribonucleoprotein complexes to effect specific degradation of target nucleic acids, such as in cancer or pathogen cells.

Example 6. In Vivo Ribonucleoprotein Specificity Assays

To investigate whether CRISPR/Cas nucleases have cytotoxic effect to the cells in their specific nuclease activity-dependent manner, the viability of the human immortalized cells that were transfected with CRISPR/Cas12a (Cpf1) nuclease were assessed in a time-dependent manner. To induce specific targeting activity of the nuclease, two crRNAs were used, a highly specific one (DHCR7) that specifically targets human DHCR7 gene, and a second guide (OsDwarf5_1) that is specific to rice dwarf5 gene, and that partially binds to sequence in human genome.

HeLa and HEK293 cells were transfected with CRISPR/Cas12a, two crRNAs (DHCR7 and OsDwarf5_1) or their RNP complexes. In 24, 48 and 72 hours after transfection, cell viability was assessed by cell viability assay using WST-1 reagent. Results are presented in FIG. 4.

The results showed that the viability of the cells transfected with CRISPR/Cas12a or crRNAs alone was not changed in all 24, 48 and 72 hours after transfection, suggesting that the nuclease or crRNAs alone does not have toxic effect to cells. In contrast, the viability of cells transfected with RNP complexes that have crRNA-guided DNA targeting activity was sharply decreased in 72 hours after transfection, which suggest that CRISPR/Cas12a is cytotoxic to cells depending on its specific DNA targeting nuclease activity. Both specific and less specific crRNAs have similar toxic effect to cells.

The viability of the similarly transfected cells was not changed (HEK293) or slightly decreased (HeLa) in 24 and 48 hours after transfection, suggesting that the toxicity need a certain period of time to affect the cells.

Considering that the double strand DNA breakage of target sequence by CRISPR/Cas nuclease in the cell increased from 24 to 48 hours after transfection, which subsequently induce the cytotoxic nonspecific nuclease activity, the toxicity shown in 72 hours after transfection suggest that it is caused by functions associated with specific nuclease activities of CRISPR/Cas12a rather than by a nuclease-independent indirect effect.

Taken together, the results suggest that CRISPR/Cas12a nuclease possesses cytotoxic effect to the cell, which depends on crRNA-mediated specific sequence targeting activity.

The results also re-emphasize that temporal restraints on CRISPR/Cas complexes increase specificity by decreasing off-target toxicity that is observed at 72 hours.

Experimental conditions for the assays were as follows. Human cell transfection HeLa and HEK293 cells were cultured in Dulbeco's Modified Eagle's Media (DMEM) supplemented with 10% Fetal Bovine Serum (FBS) at 37° C., 5% $CO_2$ incubator. 2.5×104 cells were plated in each well of 96 well plate. 1.2 nM (100 ng) or 2.4 nM (200 ng) CRISPR/Cas nuclease and 1.2 nM (25 ng) or 2.4 nM (50 ng) crRNAs were used to form the RNP complex. Each combination of nuclease, crRNA and RNP complex were transfected to cells using Lipofectamine CRISPRMAX reagent (Thermo Fisher Scientific INC.) following the manufacturer's instruction. Briefly, in one tube, each combination of nuclease, crRNA and RNP complexes were incubated with 1.7 µl of Lipofectamine Cas Plus reagent in 5 µl of Opti-MEM at room temperature (RT) for 5 minutes. In another tube, 0.3 µl of Lipofectamine CRISPRMAX reagent was mixed with 5 µl of Opti-MEM and incubated at RT for 5 minutes. Two solutions were mixed, and incubated at RT for another 10 minutes. Then the mixed solution was directly added to cells in one well of 96 well plate. In 24, 48 and 72 hours after transfection, the cell viability was assessed using WST-1 reagent.

Cell viability assay 10 µl of WST-1 reagent (Roche #0501594401) was added to each well of 96 well plate. The plate was incubated in 37 C, 5% $CO_2$ incubator until the light red color of the media changed to dark red. The media volume of each well was 100 µl. The absorbance of the samples against a background control as blank was measured using FLUOstar OMEGA ELISA reader (BMG Labtech) at wavelengths of 420~480 nm.

Example 7. In Vivo Cell Targeting

An individual is identified as suffering from cancer. The cancer may be localized to a tumor. The tumor is sequenced and a number of mutations are identified as corresponding with at least some of the tumor cells.

Further, a mutation present in a majority of the tumor cells is identified and used to specify a target sequence. A guide RNA is then synthesized to identify the target sequence and is assembled into a ribonucleoprotein complex. The complex is then administered to the patient and symptom amelioration and tumor size reduction is observed.

Example 8. Follow-on Treatment

The individual of Example 7 may continue to exhibit some symptoms, including persistent tumor growth. In such a case, the treated, reduced tumor may be resequenced. It is observed that the target sequence is no longer present, but that additional mutations may be identified.

As such, a mutation present in a majority of the tumor cells is identified and used to specify a target sequence. A guide RNA is then synthesized to identify the target sequence and is assembled into a ribonucleoprotein complex. The complex is then administered to the patient and symptom amelioration and tumor size reduction is observed.

Example 9. Follow-on Treatment

As another example, a patient suffers from leukemia. The patient is administered with the treatment imatinib mesylate (Gleevec). Some symptom amelioration is observed, but disease progression continues and the patient suffers some side effects of the treatment.

In such a case, cancer cells are sequenced. It may be observed that a genomic rearrangement resulting in coding capacity for the BCR-ABL fusion protein has occurred.

A guide RNA is then designed to target the BCR-ABL junction. That is, the guide RNA is synthesized to identify the target sequence and is assembled into a ribonucleoprotein complex. The assembled complex is then administered to the patient and symptom amelioration and leukemia remission is observed.

Example 10. Guide Nucleic Acid Design

This example describes an illustrative method for designing a guide nucleic acid for targeting a nucleic acid associated with a disorder such as cancer.

Data sources used for this example include:
1. Human reference genome sequences (e.g., hg19, GRCh37)
2. Mutation information of Cancer cell lines from Cancer Cell Line Encyclopedia (CCLE)
3. 410 Cancer mutations listed in MSK-IMPACT™ (Memorial Sloan Kettering Cancer Center—integrated mutation profiling of actionable cancer targets)

Input value included CCLE mutation information, target gene ID, target gene sequence, gRNA handle sequence, crRNA length (N), PAM (Protospacer adjacent motif) sequence, and PAM location (up- or downstream).

Guide Nucleic Acid Design—Mutation locations in CCLE (Cancer Cell Line Encyclopedia) model cell line were searched in human reference genome sequences. Sequence information of nucleic acid regions that were about 30 base pair upstream and downstream of the mutation location were determined. A PAM sequence was searched in the targeted region. The location of the PAM sequence and crRNA sequence was determined. The crRNA sequence included the mutation location. The distance between the PAM sequence of the crRNA and the mutation location was calculated. A guide RNA sequence was designed by combining the crRNA sequence and the guide RNA handle sequence.

Output information associated with the designed guide RNA obtained from this method included the following:
1. Gene ID: NCBI GenBank Identifier
2. Gene symbol: Gene nomenclature from HUGO European Bioinformatics Institute (EMBL-EBI)
3. Human genome assembly version (GRCh): Version of human genome assembly from Genome Reference Consortium Human Build
4. Chromosome number: The number of chromosome pair where target gene locate
5. Mutation start position: Start position of mutation in human reference genome
6. Mutation end position: End position of mutation in human reference genome
7. Mutation class: Class of mutation
8. Mutation type: Type of mutation, for example, insertion or deletion or single nucleotide polymorphism (SNP) or dinucleotide polymorphism (DNP)
9. Reference sequence: Sequence of human reference genome in target locus
10. Mutation sequence: Sequence of cancer cell line genome in target locus
11. Amino acid change: Amino acid change due to nucleotide mutation
12. Cancer cell line name: A name of cancer cell line which has mutation
13. Tissue of origin of tumor: Tissue from which cancer cell line originated or was first separated from
14. Ensembl transcript ID (ENST ID): Target gene transcript identifier from Ensembl genomes database
15. crRNA sequence: Extracted crRNA sequence from target mutation locus of cancer cell line. PAM sequence is included in and sequence's length varies depending on input crRNA length
16. Distance between mutation and PAM: Distance from mutation to PAM in crRNA. If PAM is upstream of crRNA, PAM's last position will be position 0, mutation in PAM will be position negative, and mutation in target cleavage site will be position positive.
   In case of Cas9, PAM is on downstream of crRNA. So PAM's first position is position 0, mutation in PAM is position negative and mutation in target cleavage site is position positive.
17. Length of mutation: Length difference between reference sequence and mutation sequence
18. Reference target sequence: ±10 nucleotide sequence from reference sequence of target locus
19. Mutation target sequence: ±10 nucleotide sequence from cancer cell line mutation sequence of target locus
20. GuideRNA sequence (Tables 5a and 6): gRNA sequence with handle and T7 RNA polymerase promoter sequences GuideRNA sequence (Tables 5b and 7): gRNA sequence with handle, tracrRNA and T7 RNA polymerase promoter sequences Table 5a, below, shows illustrative output information obtained using this example for use with a Cas12a nuclease. Variations from a reference sequence (e.g., wild type, healthy, or non-cancerous) are shown in underlined text.

TABLE 5a

| | | | |
|---|---|---|---|
| GENE_ID | 1956 | 4297 | 7157 |
| GENE_SYMBOL | EGFR | KMT2A | TP53 |
| GRCH | 37 | 37 | 37 |
| CHR | 7 | 11 | 17 |
| MUT_START | 55242465 | 118354982 | 7578205 |
| MUT_END | 55242479 | 118354983 | 7578205 |
| MUT_CLASS | In_Frame_Del | Frame_Shift_Ins | Missense_Mutation |
| MUT_TYPE | DEL | INS | SNP |
| REF_SEQ | GGAATTAAGAGAAGC (SEQ ID NO: 86) | – | C |
| MUT_SEQ | – | A | A |
| AA_CHANGE | p.ELREA746del ("ELREA" disclosed as SEQ ID NO: 87) | p.Q1391fs | p.S215I |
| CELL_LINE | NCIH1650 | NCIH2126 | NCIH661 |
| TISSUE_ORI | LUNG | LUNG | LUNG |
| ENST_ID | ENST00000275493.2 | ENST00000389506.5 | ENST00000269305.4 |

TABLE 5a-continued

| | | | |
|---|---|---|---|
| CRRNA_SEQ | TTTGATAGCGAC GGGAATTTTAAC TTTC (SEQ ID NO: 88) | TTTTTTCT TAGAACTA TTGCCATT GGAG (SEQ ID NO: 89) | TTTCGACA TATTGTGG TGGTGCCC TATG (SEQ ID NO: 90) |
| PAM_DIST | -2 | 2 | 7 |
| MUT_LEN | 15 | 1 | 0 |
| REF_TARGET | TCGCTA TCAAGG AATTAA GAGAAG CAACA TCTCCG (SEQ ID NO: 91) | TAGTTC TAAGAA AAA-TT CCA (SEQ ID NO: 92) | CACCAC CACACT ATGTCG AAA (SEQ ID NO: 93) |
| MUT_TARGET | TCGCTA TCAA-- ------- AACAT CTCCG (SEQ ID NO: 94) | TAGTTC TAAGAA AAAATT CCA (SEQ ID NO: 95) | CACCAC CACAAT ATGTCG AAA (SEQ ID NO: 96) |
| GRNA | AATTC TAATA CGACT CACTA TAGgt aaTtt ctAct aaGtg tagat ATAGC GACGG GAATT TTAAC TTTC (SEQ ID NO: 97) | AATTCTA ATACGAC TCACTAT Aggtaat Ttctact Aagtgta gatTTCT TAGAACT ATTGCCA TTGGAG (SEQ ID NO: 98) | AATTCTA ATACGAC TCACTAT Aggtaat Ttctact Aagtgta gatGACA TATTGTG GTGGTGC CCTATG (SEQ ID NO: 99) |

Table 5b, below, shows illustrative output information obtained using this example for use with a Cas9 nuclease. Variations from a reference sequence (e.g., wild type, healthy, or non-cancerous) are shown in underlined text.

TABLE 5b

| Output example (SpCas9) | | | |
|---|---|---|---|
| GENE_ID | 1956 | 4297 | 7157 |
| GENE_SYMBOL | EGFR | KMT2A | TP53 |
| GRCH | 37 | 37 | 37 |
| CHR | 7 | 11 | 17 |
| MUT_START | 55242466 | 118354982 | 7577557 |
| MUT_END | 55242480 | 118354983 | 7577557 |
| MUT_CLASS | In_Frame_Del | Frame_Shift_Ins | Missense_Mutation |
| MUT_TYPE | DEL | INS | SNP |
| REF_SEQ | GAATTAA GAGAAGCA (SEQ ID NO: 100) | — | A |

TABLE 5b-continued

| | Output example (SpCas9) | | |
|---|---|---|---|
| MUT_SEQ | — | A | G |
| AA_CHANGE | p.ELREA746del ("ELREA" disclosed as SEQ ID NO: 87) | p.Q1391fs | p.C242R |
| CELL_LINE | HCC827 | NCIH2126 | CFPAC1 |
| TISSUE_ORI | LUNG | LUNG | PANCREAS |
| ENST_ID | ENST00000275493.2 | ENST00000389506.5 | ENST00000269305.4 |
| CRRNA_SEQ | CGGAGAT GTCTTGA TAGCGAC GG (SEQ ID NO: 101) | TAAGAAA AAATTCC AGCAGAT GG (SEQ ID NO: 102) | TCCGGTT CATGCC GCCCATGCGG (SEQ ID NO: 103) |
| PAM_DIST | 12 | 16 | -1 |
| MUT_LEN | 15 | 1 | 0 |
| REF_TARGET | CGCTATC AAGGAAT TAAGAG AAGCAA CATCTC CGA (SEQ ID NO: 104) | TAGTT CTAAG- AAAAA TTCCA (SEQ ID NO: 105) | CCGCCCA TGCAGGA ACTGTTA (SEQ ID NO: 106) |
| MUT_TARGET | CGCTATCAAG ------ --------- ACATCTCCGA (SEQ ID NO: 107) | TAGTTCT AAGAAA AAATTCCA (SEQ ID NO: 95) | CCGCCC ATGCGGG AACTGTTA (SEQ ID NO: 108) |
| GRNA | Attctaatac Gactcactat AggCGCAGAT GTCTTGATAG CGAgttttag Agctagaaat agcaagttaa Aataaggcta Gtccgttatc Aacttgaaaaa gtggcaccg agtcggtgc (SEQ ID NO: 109) | Attctaatac Gactcactat AggTAACAAA AAATTCCAGC AGAgttttag Agctagaaat Agcaagttaa Aataaggcta Gtccgttatc Aacttgaaaa Agtggcaccg Agtcggtgc (SEQ ID NO: 110) | Attctaatac Gactcactat AggTCCGGTT CATGCCGCCC ATGgttttag Agctagaaat Agcaagttaa Aataaggcta Gtccgttatc Aacttgaaaa Agtggcaccg agtcggtgc (SEQ ID NO: 111) |

Example 11. Guide Nucleic Acids for Targeting Cancer

A number of guide RNA sequences are consistent with the disclosure herein.

Table 6 and paragraph [00303] lists illustrative guide RNA sequences, determined using the methods described in Example 10, which can be used to guide a polypeptide comprising a Cas12a nuclease domain (e.g., a chimeric polypeptide comprising a Cas12a nuclease) to a target nucleic acid associated with a cancer, for example, lung cancer or pancreatic cancer. Variations from a reference sequence (e.g., wild type, healthy, or non-cancerous) are shown in underlined text.

TABLE 6

Illustrative guide RNA sequences for Cas12 comprising poylpeptide

CRISPR gRNA ID: GF-CCELg12-1: [crRNA sequence]: crRNA sequence:
TTTCCTCACTGGCTTCAGCGATTCCACA (SEQ ID NO: 112): LbgRNA:
AATTCTAATACGACTCACTATAGgtaatttctactaagtgtagat CTCACTGGCTTCAGCGATTCCACA
(SEQ ID NO: 113): [Target gene information]: Gene ID: 29123: Symbol: ANKRD11:
Ensembl_Transcript_ID: ENST00000301030.4: GRCh: 37: Chr: 16: [Target cancer mutation TABLE 6-continued Illustrative guide RNA sequences for Cas12 comprising poylpeptide information]: mut_start: 89351168: mut_end: 89351168: mut_class: Silent: mut_type: SNP:
ref_seq: C: mut_seq: T: mut_aa: p.K594K: mutation info source: CCLE: ref_target(-10 +10):
GCTCCTGCCTCTTCCTCACTG (SEQ ID NO: 114): mut_target(-10 +10):
GCTCCTGCCTTTTCCTCACTG (SEQ ID NO: 115): [Model Cell line information]: cell:
NCIH1573: cancer_type: LUNG: PAM_dist: -3: indel length: 0: CRISPR gRNA ID: GF-
CCELg12-2: [crRNA sequence]: crRNA sequence: TTTTCCTCACTGGCTTCAGCGATTCCAC
(SEQ ID NO: 116): LbgRNA: AATTCTAATACGACTCACTATAGgtaatttctactaagtgtagat
CCTCACTGGCTTCAGCGATTCCAC (SEQ ID NO: 117): [Target gene information]: Gene ID:
29123: Symbol: ANKRD11: Ensembl_Transcript_ID: ENST00000301030.4: GRCh: 37: Chr: 16:
[Target cancer mutation information]: mut_start: 89351168: mut_end: 89351168: mut_class: Silent:
mut_type: SNP: ref_seq: C: mut_seq: T: mut_aa: p.K594K: mutation info source: CCLE:
ref_target(-10 +10): GCTCCTGCCTCTTCCTCACTG (SEQ ID NO: 114): mut_target(-10 +10):
GCTCCTGCCTTTTCCTCACTG (SEQ ID NO: 115): [Model Cell line information]: cell:
NCIH1573: cancer_type: LUNG: PAM_dist: -2: indel length: 0: CRISPR gRNA ID: GF-
CCELg12-3: [crRNA sequence]: crRNA sequence: TTTCTTCAGGAACGAAATCTCCCTCCAA
(SEQ ID NO: 118): LbgRNA: AATTCTAATACGACTCACTATAGgtaatttctactaagtgtagat
TTCAGGAACGAAATCTCCCTCAA (SEQ ID NO: 119): [Target gene information]: Gene ID:
324: Symbol: APC: Ensembl_Transcript_ID: ENST00000457016.1: GRCh: 37: Chr: 5: [Target
cancer mutation information]: mut_start: 112175363: mut_end: 112175363: mut_class:
Missense_Mutation: mut_type: SNP: ref_seq: G: mut_seq: A: mut_aa: p.A1358T: mutation info
source: CCLE: ref_target(-10 +10): TTCTTCAGGAGCGAAATCTCC (SEQ ID NO: 120):
mut_target(-10 +10): TTCTTCAGGAACGAAATCTCC (SEQ ID NO: 121): [Model Cell line
information]: cell: NCIH1650: cancer_type: LUNG: PAM_dist: 8: indel length: 0: CRISPR
gRNA ID: GF-CCELg12-4: [crRNA sequence]: crRNA sequence:
TTTTCTTCAGGAACGAAATCTCCCTCCA (SEQ ID NO: 122): LbgRNA:
AATTCTAATACGACTCACTATAGgtaatttctactaagtgtagat CTTCAGGAACGAAATCTCCCTCCA
(SEQ ID NO: 123): [Target gene information]: Gene ID: 324: Symbol: APC:
Ensembl_Transcript_ID: ENST00000457016.1: GRCh: 37: Chr: 5: [Target cancer mutation
information]: mut_start: 112175363: mut_end: 112175363: mut_class: Missense_Mutation:
mut_type: SNP: ref_seq: G: mut_seq: A: mut_aa: p.A1358T: mutation info source: CCLE:
ref_target(-10 +10): TTCTTCAGGAGCGAAATCTCC (SEQ ID NO: 120): mut_target(-10 +10):
TTCTTCAGGAACGAAATCTCC (SEQ ID NO: 121): [Model Cell line information]: cell:
NCIH1650: cancer_type: LUNG: PAM_dist: 9: indel length: 0: CRISPR gRNA ID: GF-
CCELg12-5: [crRNA sequence]: crRNA sequence: TTTCGTTCCTGAAGAAAATTCAACAGCT
(SEQ ID NO: 124): LbgRNA: AATTCTAATACGACTCACTATAGgtaatttctactaagtgtagat
GTTCCTGAAGAAAATTCAACAGCT (SEQ ID NO: 125): [Target gene information]: Gene ID:
324: Symbol: APC: Ensembl_Transcript_ID: ENST00000457016.1: GRCh: 37: Chr: 5: [Target
cancer mutation information]: mut_start: 112175363: mut_end: 112175363: mut_class:
Missense_Mutation: mut_type: SNP: ref_seq: G: mut_seq: A: mut_aa: p.A1358T: mutation info
source: CCLE: ref_target(-10 +10): TTCTTCAGGAGCGAAATCTCC (SEQ ID NO: 120):
mut_target(-10 +10): TTCTTCAGGAACGAAATCTCC (SEQ ID NO: 121): [Model Cell line
information]: cell: NCIH1650: cancer_type: LUNG: PAM_dist: 2: indel length: 0: CRISPR
gRNA ID: GF-CCELg12-6: [crRNA sequence]: crRNA sequence:
TTTGGAGGGAGATTTCGTTCCTGAAGAA (SEQ ID NO: 126): LbgRNA:
AATTCTAATACGACTCACTATAGgtaatttctactaagtgtagat GAGGGAGATTTCGTTCCTGAAGAA
(SEQ ID NO: 127): [Target gene information]: Gene ID: 324: Symbol: APC:
Ensembl_Transcript_ID: ENST00000457016.1: GRCh: 37: Chr: 5: [Target cancer mutation
information]: mut_start: 112175363: mut_end: 112175363: mut_class: Missense_Mutation:
mut_type: SNP: ref_seq: G: mut_seq: A: mut_aa: p.A1358T: mutation info source: CCLE:
ref_target(-10 +10): TTCTTCAGGAGCGAAATCTCC (SEQ ID NO: 120): mut_target(-10 +10):
TTCTTCAGGAACGAAATCTCC (SEQ ID NO: 121): [Model Cell line information]: cell:
NCIH1650: cancer_type: LUNG: PAM_dist: 14: indel length: 0: CRISPR gRNA ID: GF-
CCELg12-7: [crRNA sequence]: crRNA sequence: TTTTGGAGGGAGATTTCGTTCCTGAAGA
(SEQ ID NO: 128): LbgRNA: AATTCTAATACGACTCACTATAGgtaatttctactaagtgtagat
GGAGGGAGATTTCGTTCCTGAAGA (SEQ ID NO: 129): [Target gene information]: Gene ID:
324: Symbol: APC: Ensembl_Transcript_ID: ENST00000457016.1: GRCh: 37: Chr: 5: [Target
cancer mutation information]: mut_start: 112175363: mut_end: 112175363: mut_class:
Missense_Mutation: mut_type: SNP: ref_seq: G: mut_seq: A: mut_aa: p.A1358T: mutation info
source: CCLE: ref_target(-10 +10): TTCTTCAGGAGCGAAATCTCC (SEQ ID NO: 120):
mut_target(-10 +10): TTCTTCAGGAACGAAATCTCC (SEQ ID NO: 121): [Model Cell line
information]: cell: NCIH1650: cancer_type: LUNG: PAM_dist: 15: indel length: 0: CRISPR
gRNA ID: GF-CCELg12-8: [crRNA sequence]: crRNA sequence:
TTTCAGGGAAAGGATGCAATCTGAATCA (SEQ ID NO: 130): LbgRNA:
AATTCTAATACGACTCACTATAGgtaatttctactaagtgtagat AGGGAAAGGATGCAATCTGAATCA
(SEQ ID NO: 131): [Target gene information]: Gene ID: 324: Symbol: APC:
Ensembl_Transcript_ID: ENST00000457016.1: GRCh: 37: Chr: 5: [Target cancer mutation
information]: mut_start: 112177692: mut_end: 112177692: mut_class: Missense_Mutation:
mut_type: SNP: ref_seq: C: mut_seq: G: mut_aa: p.S2134C: mutation info source: CCLE:
ref_target(-10 +10): GATTCAGATTCCATCCTTTCC (SEQ ID NO: 132): mut_target(-10 +10):
GATTCAGATTGCATCCTTTCC (SEQ ID NO: 133): [Model Cell line information]: cell:
NCIH1975: cancer_type: LUNG: PAM_dist: 13: indel length: 0: CRISPR gRNA ID: GF-
CCELg12-9: [crRNA sequence]: crRNA sequence: TTTGAGACACCTGGGTCCATTATTGTCA
(SEQ ID NO: 134): LbgRNA: AATTCTAATACGACTCACTATAGgtaatttctactaagtgtagat
AGACACCTGGGTCCATTATTGTCA (SEQ ID NO: 135): [Target gene information]: Gene ID:
171023: Symbol: ASXL1: Ensembl_Transcript_ID: ENST00000375687.4: GRCh: 37: Chr: 20:
[Target cancer mutation information]: mut_start: 31019180: mut_end: 31019180: mut_class:
Missense_Mutation: mut_type: SNP: ref_seq: C: mut_seq: A: mut_aa: p.L259I: mutation info
source: CCLE: ref_target(-10 +10): TGGGTCCATTCTTGTCAACAC (SEQ ID NO: 136):

TABLE 6-continued

Illustrative guide RNA sequences for Cas12 comprising poylpeptide mut_target(-10 +10): TGGGTCCATTATTGTCAACAC (SEQ ID NO: 137): [Model Cell line
information]: cell: NCIH1573: cancer_type: LUNG: PAM_dist: 18: indel length: 0: CRISPR
gRNA ID: GF-CCELg12-10: [crRNA sequence]: crRNA sequence:
TTTTGAGACACCTGGGTCCATTATTGTC (SEQ ID NO: 138): LbgRNA:
AATTCTAATACGACTCACTATAGgtaatttctactaagtgtagat GAGACACCTGGGTCCATTATTGTC
(SEQ ID NO: 139): [Target gene information]: Gene ID: 171023: Symbol: ASXL1:
Ensembl_Transcript_ID: ENST00000375687.4: GRCh: 37: Chr: 20: [Target cancer mutation
information]: mut_start: 31019180: mut_end: 31019180: mut_class: Missense_Mutation:
mut_type: SNP: ref_seq: C: mut_seq: A: mut_aa: p.L259I: mutation info source: CCLE:
ref_target(-10 +10): TGGGTCCATTCTTGTCAACAC (SEQ ID NO: 136): mut_target(-10 +10):
TGGGTCCATTATTGTCAACAC (SEQ ID NO: 137): [Model Cell line information]: cell:
NCIH1573: cancer_type: LUNG: PAM_dist: 19: indel length: 0: CRISPR gRNA ID: GF-
CCELg12-11: [crRNA sequence]: crRNA sequence: TTTGGGTAGGAGACTGTTTGATTCCTGG
(SEQ ID NO: 140): LbgRNA: AATTCTAATACGACTCACTATAGgtaatttctactaagtgtagat
GGTAGGAGACTGTTTGATTCCTGG (SEQ ID NO: 141): [Target gene information]: Gene ID:
171023: Symbol: ASXL1: Ensembl_Transcript_ID: ENST00000375687.4: GRCh: 37: Chr: 20:
[Target cancer mutation information]: mut_start: 31021717: mut_end: 31021718: mut_class:
Missense_Mutation: mut_type: DNP: ref_seq: CC: mut_seq: TT: mut_aa: p.R573W: mutation
info source: CCLE: ref_target(-10 +10): TCCCGCCCATCCGGGTAGGAGA (SEQ ID NO: 142):
mut_target(-10 +10): TCCCGCCCATTTTGGGTAGGAGA (SEQ ID NO: 143): [Model Cell line
information]: cell: NCIH1573: cancer_type: LUNG: PAM_dist: -2: indel length: 0: CRISPR
gRNA ID: GF-CCELg12-12: [crRNA sequence]: crRNA sequence:
TTTGCTCCATGGGAACATCTTTGCCTTA    (SEQ ID NO: 144): LbgRNA:
AATTCTAATACGACTCACTATAGgtaatttctactaagtgtagat CTCCATGGGAACATCTTTGCCTTA
(SEQ ID NO: 145): [Target gene information]: Gene ID: 55252: Symbol: ASXL2:
Ensembl_Transcript_ID: ENST00000435504.4: GRCh: 37: Chr: 2: [Target cancer mutation
information]: mut_start: 25966334: mut_end: 25966334: mut_class: Nonsense_Mutation:
mut_type: SNP: ref_seq: G: mut_seq: A: mut_aa: p.Q958*: mutation info source: CCLE:
ref_target(-10 +10): TCTTTGCCTTGAAGCAGCTGA (SEQ ID NO: 146): mut_target(-10 +10):
TCTTTGCCTTAAAGCAGCTGA (SEQ ID NO: 147): [Model Cell line information]: cell:
HCC827GR5: cancer_type: LUNG: PAM_dist: 24: indel length: 0: CRISPR gRNA ID: GF-
CCELg12-13: [crRNA sequence]: crRNA sequence: TTTGCCTTAAAGCAGCTGAGTCACTAAA
(SEQ ID NO: 148): LbgRNA: AATTCTAATACGACTCACTATAGgtaatttctactaagtgtagat
CCTTAAAGCAGCTGAGTCACTAAA (SEQ ID NO: 149): [Target gene information]: Gene ID:
55252: Symbol: ASXL2: Ensembl_Transcript_ID: ENST00000435504.4: GRCh: 37: Chr: 2:
[Target cancer mutation information]: mut_start: 25966334: mut_end: 25966334: mut_class:
Nonsense_Mutation: mut_type: SNP: ref_seq: G: mut_seq: A: mut_aa: p.Q958*: mutation info
source: CCLE: ref_target(-10 +10): TCTTTGCCTTGAAGCAGCTGA (SEQ ID NO: 146):
mut_target(-10 +10): TCTTTGCCTTAAAGCAGCTGA (SEQ ID NO: 147): [Model Cell line
information]: cell: HCC827GR5: cancer_type: LUNG: PAM_dist: 5: indel length: 0:: CRISPR
gRNA ID: GF-CCELg12-14: [crRNA sequence]: crRNA sequence:
TTTAGTGACTCAGCTGCTTTAAGGCAAA (SEQ ID NO: 150): LbgRNA:
AATTCTAATACGACTCACTATAGgtaatttctactaagtgtagat GTGACTCAGCTGCTTTAAGGCAAA
(SEQ ID NO: 151): [Target gene information]: Gene ID: 55252: Symbol: ASXL2:
Ensembl_Transcript_ID: ENST00000435504.4: GRCh: 37: Chr: 2: [Target cancer mutation
information]: mut_start: 25966334: mut_end: 25966334: mut_class: Nonsense_Mutation:
mut_type: SNP: ref_seq: G: mut_seq: A: mut_aa: p.Q958*: mutation info source: CCLE:
ref_target(-10 +10): TCTTTGCCTTGAAGCAGCTGA (SEQ ID NO: 146): mut_target(-10 +10):
TCTTTGCCTTAAAGCAGCTGA (SEQ ID NO: 147): [Model Cell line information]: cell:
HCC827GR5: cancer_type: LUNG: PAM_dist: 16: indel length: 0: CRISPR gRNA ID: GF-
CCELg12-15: [crRNA sequence]: crRNA sequence: TTTAAGGCAAAGATGTTCCCATGGAGCA
(SEQ ID NO: 152): LbgRNA: AATTCTAATACGACTCACTATAGgtaatttctactaagtgtagat
AGGCAAAGATGTTCCCATGGAGCA (SEQ ID NO: 153): [Target gene information]: Gene ID:
55252: Symbol: ASXL2: Ensembl_Transcript_ID: ENST00000435504.4: GRCh: 37: Chr: 2:
[Target cancer mutation information]: mut_start: 25966334: mut_end: 25966334: mut_class:
Nonsense_Mutation: mut_type: SNP: ref_seq: G: mut_seq: A: mut_aa: p.Q958*: mutation info
source: CCLE: ref_target(-10 +10): TCTTTGCCTTGAAGCAGCTGA (SEQ ID NO: 146):
mut_target(-10 +10): TCTTTGCCTTAAAGCAGCTGA (SEQ ID NO: 147): [Model Cell line
information]: cell: HCC827GR5: cancer_type: LUNG: PAM_dist: -1: indel length: 0: CRISPR
gRNA ID: GF-CCELg12-16: [crRNA sequence]: crRNA sequence:
TTTCTGTGAGAAAGTACTGGTGTGAAAT (SEQ ID NO: 154): LbgRNA:
AATTCTAATACGACTCACTATAGgtaatttctactaagtgtagat TGTGAGAAAGTACTGGTGTGAAAT
(SEQ ID NO: 155): [Target gene information]: Gene ID: 472: Symbol: ATM:
Ensembl_Transcript_ID: ENST00000452508.2: GRCh: 37: Chr: 11: [Target cancer mutation
information]: mut_start: 108106527: mut_end: 108106527: mut_class: Silent: mut_type: SNP:
ref_seq: A: mut_seq: G: mut_aa: p.K154K: mutation info source: CCLE: ref_target(-10 +10):
CTGTGAGAAAATACTGGTGTG (SEQ ID NO: 156): mut_target(-10 +10):
CTGTGAGAAAGTACTGGTGTG (SEQ ID NO: 157): [Model Cell line information]: cell:
SW1990: cancer_type: PANCREAS: PAM_dist: 10: indel length: 0: CRISPR gRNA ID: GF-
CCELg12-17: [crRNA sequence]: crRNA sequence: TTTCACACCAGTACTTTCTCACAGAAAG
(SEQ ID NO: 158): LbgRNA: AATTCTAATACGACTCACTATAGgtaatttctactaagtgtagat
ACACCAGTACTTTCTCACAGAAAG (SEQ ID NO: 159): [Target gene information]: Gene ID:
472: Symbol: ATM: Ensembl_Transcript_ID: ENST00000452508.2: GRCh: 37: Chr: 11: [Target
cancer mutation information]: mut_start: 108106527: mut_end: 108106527: mut_class: Silent:
mut_type: SNP: ref_seq: A: mut_seq: G: mut_aa: p.K154K: mutation info source: CCLE:
ref_target(-10 +10): CTGTGAGAAAATACTGGTGTG (SEQ ID NO: 156): mut_target(-10 +10):
CTGTGAGAAAGTACTGGTGTG (SEQ ID NO: 157): [Model Cell line information]: cell:

TABLE 6-continued

Illustrative guide RNA sequences for Cas12 comprising poylpeptide

SW1990: cancer_type: PANCREAS: PAM_dist: 10: indel length: 0: CRISPR gRNA ID: GF-
CCELg12-18: [crRNA sequence]: crRNA sequence: TTTCTTGAAGATTTTTACAAAAATATAT
(SEQ ID NO: 160): LbgRNA: AATTCTAATACGACTCACTATAGgtaatttctactaagtgtagat
TTGAAGATTTTTACAAAAATATAT (SEQ ID NO: 161): [Target gene information]: Gene ID:
472: Symbol: ATM: Ensembl_Transcript_ID: ENST00000452508.2: GRCh: 37: Chr: 11: [Target
cancer mutation information]: mut_start: 108099914: mut_end: 108099914: mut_class: Silent:
mut_type: SNP: ref_seq: G: mut_seq: A: mut_aa: p.Q65Q: mutation info source: CCLE:
ref_target(-10 +10): GATTTTTACAGAAATATATTC (SEQ ID NO: 162): mut_target(-10 +10):
GATTTTTACAAAAATATATTC (SEQ ID NO: 163): [Model Cell line information]: cell:
NCIH1573: cancer_type: LUNG: PAM_dist: 16: indel length: 0: CRISPR gRNA ID: GF-
CCELg12-19: [crRNA sequence]: crRNA sequence: TTTGTTTTCTTGAAGATTTTTACAAAAA
(SEQ ID NO: 164): LbgRNA: AATTCTAATACGACTCACTATAGgtaatttctactaagtgtagat
TTTTCTTGAAGATTTTTACAAAAA (SEQ ID NO: 165): [Target gene information]: Gene ID:
472: Symbol: ATM: Ensembl_Transcript_ID: ENST00000452508.2: GRCh: 37: Chr: 11: [Target
cancer mutation information]: mut_start: 108099914: mut_end: 108099914: mut_class: Silent:
mut_type: SNP: ref_seq: G: mut_seq: A: mut_aa: p.Q65Q: mutation info source: CCLE:
ref_target(-10 +10): GATTTTTACAGAAATATATTC (SEQ ID NO: 162): mut_target(-10 +10):
GATTTTTACAAAAATATATTC (SEQ ID NO: 163): [Model Cell line information]: cell:
NCIH1573: cancer_type: LUNG: PAM_dist: 21: indel length: 0: CRISPR gRNA ID: GF-
CCELg12-20: [crRNA sequence]: crRNA sequence: TTTACAAAAATATATTCAGAAAGAAACA
(SEQ ID NO: 166): LbgRNA: AATTCTAATACGACTCACTATAGgtaatttctactaagtgtagat
CAAAAATATATTCAGAAAGAAACA (SEQ ID NO: 167): [Target gene information]: Gene ID:
472: Symbol: ATM: Ensembl_Transcript_ID: ENST00000452508.2: GRCh: 37: Chr: 11: [Target
cancer mutation information]: mut_start: 108099914: mut_end: 108099914: mut_class: Silent:
mut_type: SNP: ref_seq: G: mut_seq: A: mut_aa: p.Q65Q: mutation info source: CCLE:
ref_target(-10 +10): GATTTTTACAGAAATATATTC (SEQ ID NO: 162): mut_target(-10 +10):
GATTTTTACAAAAATATATTC (SEQ ID NO: 163): [Model Cell line information]: cell:
NCIH1573: cancer_type: LUNG: PAM_dist: 3: indel length: 0: CRISPR gRNA ID: GF-
CCELg12-21: [crRNA sequence]: crRNA sequence: TTTTGTTTTCTTGAAGATTTTTACAAAA
(SEQ ID NO: 168): LbgRNA: AATTCTAATACGACTCACTATAGgtaatttctactaagtgtagat
GTTTTCTTGAAGATTTTTACAAAAA (SEQ ID NO: 169): [Target gene information]: Gene ID:
472: Symbol: ATM: Ensembl_Transcript_ID: ENST00000452508.2: GRCh: 37: Chr: 11: [Target
cancer mutation information]: mut_start: 108099914: mut_end: 108099914: mut_class: Silent:
mut_type: SNP: ref_seq: G: mut_seq: A: mut_aa: p.Q65Q: mutation info source: CCLE:
ref_target(-10 +10): GATTTTTACAGAAATATATTC (SEQ ID NO: 162): mut_target(-10 +10):
GATTTTTACAAAAATATATTC (SEQ ID NO: 163): [Model Cell line information]: cell:
NCIH1573: cancer_type: LUNG: PAM_dist: 22: indel length: 0: CRISPR gRNA ID: GF-
CCELg12-22: [crRNA sequence]: crRNA sequence: TTTTCTTGAAGATTTTTACAAAAATATA
(SEQ ID NO: 170): LbgRNA: AATTCTAATACGACTCACTATAGgtaatttctactaagtgtagat
CTTGAAGATTTTTACAAAAATATA (SEQ ID NO: 171): [Target gene information]: Gene ID:
472: Symbol: ATM: Ensembl_Transcript_ID: ENST00000452508.2: GRCh: 37: Chr: 11: [Target
cancer mutation information]: mut_start: 108099914: mut_end: 108099914: mut_class: Silent:
mut_type: SNP: ref_seq: G: mut_seq: A: mut_aa: p.Q65Q: mutation info source: CCLE:
ref_target(-10 +10): GATTTTTACAGAAATATATTC (SEQ ID NO: 162): mut_target(-10 +10):
GATTTTTACAAAAATATATTC (SEQ ID NO: 163): [Model Cell line information]: cell:
NCIH1573: cancer_type: LUNG: PAM_dist: 17: indel length: 0: CRISPR gRNA ID: GF-
CCELg12-23: [crRNA sequence]: crRNA sequence: TTTTTACAAAAATATATTCAGAAAGAAA
(SEQ ID NO: 172): LbgRNA: AATTCTAATACGACTCACTATAGgtaatttctactaagtgtagat
TACAAAAATATATTCAGAAAGAAA (SEQ ID NO: 173): [Target gene information]: Gene ID:
472: Symbol: ATM: Ensembl_Transcript_ID: ENST00000452508.2: GRCh: 37: Chr: 11: [Target
cancer mutation information]: mut_start: 108099914: mut_end: 108099914: mut_class: Silent:
mut_type: SNP: ref_seq: G: mut_seq: A: mut_aa: p.Q65Q: mutation info source: CCLE:
ref_target(-10 +10): GATTTTTACAGAAATATATTC (SEQ ID NO: 162): mut_target(-10 +10):
GATTTTTACAAAAATATATTC (SEQ ID NO: 163): [Model Cell line information]: cell:
NCIH1573: cancer_type: LUNG: PAM_dist: 5: indel length: 0: CRISPR gRNA ID: GF-
CCELg12-24: [crRNA sequence]: crRNA sequence: TTTTACAAAAATATATTCAGAAAGAAAC
(SEQ ID NO: 174): LbgRNA: AATTCTAATACGACTCACTATAGgtaatttctactaagtgtagat
ACAAAAATATATTCAGAAAGAAAC (SEQ ID NO: 175): [Target gene information]: Gene ID:
472: Symbol: ATM: Ensembl_Transcript_ID: ENST00000452508.2: GRCh: 37: Chr: 11: [Target
cancer mutation information]: mut_start: 108099914: mut_end: 108099914: mut_class: Silent:
mut_type: SNP: ref_seq: G: mut_seq: A: mut_aa: p.Q65Q: mutation info source: CCLE:
ref_target(-10 +10): GATTTTTACAGAAATATATTC (SEQ ID NO: 162): mut_target(-10 +10):
GATTTTTACAAAAATATATTC (SEQ ID NO: 163): [Model Cell line information]: cell:
NCIH1513: cancer_type: LUNG: PAM_dist: 4: indel length: 0: CRISPR gRNA ID: GF-
CCELg12-25: [crRNA sequence]: crRNA sequence: TTTCTTTCTGAATATATTTTTGTAAAAA
(SEQ ID NO: 176): LbgRNA: AATTCTAATACGACTCACTATAGgtaatttctactaagtgtagat
TTTCTGAATATATTTTTGTAAAAA (SEQ ID NO: 177): [Target gene information]: Gene ID:
472: Symbol: ATM: Ensembl_Transcript_ID: ENST00000452508.2: GRCh: 37: Chr: 11: [Target
cancer mutation information]: mut_start: 108099914: mut_end: 108099914: mut_class: Silent:
mut_type: SNP: ref_seq: G: mut_seq: A: mut_aa: p.Q65Q: mutation info source: CCLE:
ref_target(-10 +10): GATTTTTACAGAAATATATTC (SEQ ID NO: 162): mut_target(-10 +10):
GATTTTTACAAAAATATATTC (SEQ ID NO: 163): [Model Cell line information]: cell:
NCIH1573: cancer_type: LUNG: PAM_dist: 16: indel length: 0: CRISPR gRNA ID: GF-
CCELg12-26: [crRNA sequence]: crRNA sequence: TTTCTGAATATATTTTTGTAAAAATCTT
(SEQ ID NO: 178): LbgRNA: AATTCTAATACGACTCACTATAGgtaatttctactaagtgtagat
TGAATATATTTTTGTAAAAATCTT (SEQ ID NO: 179): [Target gene information]: Gene ID:
472: Symbol: ATM: Ensembl_Transcript_ID: ENST00000452508.2: GRCh: 37: Chr: 11: [Target
cancer mutation information]: mut_start: 108099914: mut_end: 108099914: mut_class: Silent:

TABLE 6-continued

Illustrative guide RNA sequences for Cas12 comprising poylpeptide mut_type: SNP: ref_seq: G: mut_seq: A: mut_aa: p.Q65Q: mutation info source: CCLE:
ref_target(-10 +10): GATTTTTACAGAAATATATTC (SEQ ID NO: 162): mut_target(-10 +10):
GATTTTTACAAAAATATATTC (SEQ ID NO: 163): [Model Cell line information]: cell:
NCIH1573: cancer_type: LUNG: PAM_dist: 12: indel length: 0: CRISPR gRNA ID: GF-
CCELg12-27: [crRNA sequence]: crRNA sequence: TTTGTAAAAATCTTCAAGAAAACAAAAT
(SEQ ID NO: 180): LbgRNA: AATTCTAATACGACTCACTATAGgtaatttctactaagtgtagat
TAAAAATCTTCAAGAAAACAAAAT (SEQ ID NO: 181): [Target gene information]: Gene ID:
472: Symbol: ATM: Ensembl_Transcript_ID: ENST00000452508.2: GRCh: 37: Chr: 11: [Target
cancer mutation information]: mut_start: 108099914: mut_end: 108099914: mut_class: Silent:
mut_type: SNP: ref_seq: G: mut_seq: A: mut_aa: p.Q65Q: mutation info source: CCLE:
ref_target(-10 +10): GATTTTTACAGAAATATATTC (SEQ ID NO: 162): mut_target(-10 +10):
GATTTTTACAAAAATATATTC (SEQ ID NO: 163): [Model Cell line information]: cell:
NCIH1573: cancer_type: LUNG: PAM_dist: -2: indel length: 0: CRISPR gRNA ID: GF-
CCELg12-28: [crRNA sequence]: crRNA sequence: TTTTTGTAAAAATCTTCAAGAAAACAAA
(SEQ ID NO: 182): LbgRNA: AATTCTAATACGACTCACTATAGgtaatttctactaagtgtagat
TGTAAAAATCTTCAAGAAAACAAA (SEQ ID NO: 183): [Target gene information]: Gene ID:
472: Symbol: ATM: Ensembl_Transcript_ID: ENST00000452508.2: GRCh: 37: Chr: 11: [Target
cancer mutation information]: mut_start: 108099914: mut_end: 108099914: mut_class: Silent:
mut_type: SNP: ref_seq: G: mut_seq: A: mut_aa: p.Q65Q: mutation info source: CCLE:
ref_target(-10 +10): GATTTTTACAGAAATATATTC (SEQ ID NO: 162): mut_target(-10 +10):
GATTTTTACAAAAATATATTC (SEQ ID NO: 163): [Model Cell line information]: cell:
NCIH1573: cancer_type: LUNG: PAM_dist: 0: indel length: 0: CRISPR gRNA ID: GF-
CCELg12-29: [crRNA sequence]: crRNA sequence: TTTTGTAAAAATCTTCAAGAAAACAAAA
(SEQ ID NO: 184): LbgRNA: AATTCTAATACGACTCACTATAGgtaatttctactaagtgtagat
GTAAAAATCTTCAAGAAAACAAAA (SEQ ID NO: 185): [Target gene information]: Gene ID:
472: Symbol: ATM: Ensembl_Transcript_ID: ENST00000452508.2: GRCh: 37: Chr: 11: [Target
cancer mutation information]: mut_start: 108099914: mut_end: 108099914: mut_class: Silent:
mut_type: SNP: ref_seq: G: mut_seq: A: mut_aa: p.Q65Q: mutation info source: CCLE:
ref_target(-10 +10): GATTTTTACAGAAATATATTC (SEQ ID NO: 162): mut_target(-10 +10):
GATTTTTACAAAAATATATTC (SEQ ID NO: 163): [Model Cell line information]: cell:
NCIH1573: cancer_type: LUNG: PAM_dist: -1: indel length: 0: CRISPR gRNA ID: GF-
CCELg12-30: [crRNA sequence]: crRNA sequence: TTTGCGGCCTTAAAATTAAAAACAACAT
(SEQ ID NO: 186): LbgRNA: AATTCTAATACGACTCACTATAGgtaatttctactaagtgtagat
CGGCCTTAAAATTAAAAACAACAT (SEQ ID NO: 187): [Target gene information]: Gene ID:
545: Symbol: ATR: Ensembl_Transcript_ID: ENST00000350721.4: GRCh: 37: Chr: 3: [Target
cancer mutation information]: mut_start: 142272241: mut_end: 142272241: mut_class: Splice_Site:
mut_type: SNP: ref_seq: C: mut_seq: T: mut_aa: FALSE: mutation info source: CCLE:
ref_target(-10 +10): TTTTGCGGCCCTAAAATTAAA (SEQ ID NO: 188): mut_target(-10 +10):
TTTTGCGGCCTTAAAATTAAA (SEQ ID NO: 189): [Model Cell line information]: cell: A549:
cancer_type: LUNG: PAM_dist: 6: indel length: 0: CRISPR gRNA ID: GF-CCELg12-31:
[crRNA sequence]: crRNA sequence: TTTTGCGGCCTTAAAATTAAAAACAACA (SEQ ID NO:
190): LbgRNA: AATTCTAATACGACTCACTATAGgtaatttctactaagtgtagat
GCGGCCTTAAAATTAAAAACAACA (SEQ ID NO: 191): [Target gene information]: Gene ID:
545: Symbol: ATR: Ensembl_Transcript_ID: ENST00000350721.4: GRCh: 37: Chr: 3: [Target
cancer mutation information]: mut_start: 142272241: mut_end: 142272241: mut_class: Splice_Site:
mut_type: SNP: ref_seq: C: mut_seq: T: mut_aa: FALSE: mutation info source: CCLE:
ref_target(-10 +10): TTTTGCGGCCCTAAAATTAAA (SEQ ID NO: 188): mut_target(-10 +10):
TTTTGCGGCCTTAAAATTAAA (SEQ ID NO: 189): [Model Cell line information]: cell: A549:
cancer_type: LUNG: PAM_dist: 7: indel length: 0: CRISPR gRNA ID: GF-CCELg12-32:
[crRNA sequence]: crRNA sequence: TTTAATTTTAAGGCCGCAAAAGGAGATT (SEQ ID NO:
192): LbgRNA: AATTCTAATACGACTCACTATAGgtaatttctactaagtgtagat
ATTTTAAGGCCGCAAAAGGAGATT (SEQ ID NO: 193): [Target gene information]: Gene ID:
545: Symbol: ATR: Ensembl_Transcript_ID: ENST00000350721.4: GRCh: 37: Chr: 3: [Target
cancer mutation information]: mut_start: 142272241: mut_end: 142272241: mut_class: Splice_Site:
mut_type: SNP: ref_seq: C: mut_seq: T: mut_aa: FALSE: mutation info source: CCLE:
ref_target(-10 +10): TTTTGCGGCCCTAAAATTAAA (SEQ ID NO: 188): mut_target(-10 +10):
TTTTGCGGCCTTAAAATTAAA (SEQ ID NO: 189): [Model Cell line information]: cell: A549:
cancer_type: LUNG: PAM_dist: 7: indel length: 0: CRISPR gRNA ID: GF-CCELg12-33:
[crRNA sequence]: crRNA sequence: TTTAAGGCCGCAAAAGGAGATTTGGTAC (SEQ ID NO:
194): LbgRNA: AATTCTAATACGACTCACTATAGgtaatttctactaagtgtagat
AGGCCGCAAAAGGAGATTTGGTAC (SEQ ID NO: 195): [Target gene information]: Gene ID:
545: Symbol: ATR: Ensembl_Transcript_ID: ENST00000350721.4: GRCh: 37: Chr: 3: [Target
cancer mutation information]: mut_start: 142272241: mut_end: 142272241: mut_class: Splice_Site:
mut_type: SNP: ref_seq: C: mut_seq: T: mut_aa: FALSE: mutation info source: CCLE:
ref_target(-10 +10): TTTTGCGGCCCTAAAATTAAA (SEQ ID NO: 188): mut_target(-10 +10):
TTTTGCGGCCTTAAAATTAAA (SEQ ID NO: 189): [Model Cell line information]: cell: A549:
cancer_type: LUNG: PAM_dist: 1: indel length: 0: CRISPR gRNA ID: GF-CCELg12-34:
[crRNA sequence]: crRNA sequence: TTTTTAATTTTAAGGCCGCAAAAGGAGA (SEQ ID NO:
196): LbgRNA: AATTCTAATACGACTCACTATAGgtaatttctactaagtgtagat
TAATTTTAAGGCCGCAAAAGGAGA (SEQ ID NO: 197): [Target gene information]: Gene ID:
545: Symbol: ATR: Ensembl_Transcript_ID: ENST00000350721.4: GRCh: 37: Chr: 3: [Target
cancer mutation information]: mut_start: 142272241: mut_end: 142272241: mut_class: Splice_Site:
mut_type: SNP: ref_seq: C: mut_seq: T: mut_aa: FALSE: mutation info source: CCLE:
ref_target(-10 +10): TTTTGCGGCCCTAAAATTAAA (SEQ ID NO: 188): mut_target(-10 +10):
TTTTGCGGCCTTAAAATTAAA (SEQ ID NO: 189): [Model Cell line information]: cell: A549:
cancer_type: LUNG: PAM_dist: 9: indel length: 0: CRISPR gRNA ID: GF-CCELg12-35:

TABLE 6-continued

Illustrative guide RNA sequences for Cas12 comprising poylpeptide

[crRNA sequence]: crRNA sequence: TTTTAATTTTAAGGCCGCAAAAGGAGAT (SEQ ID NO: 198): LbgRNA: AATTCTAATACGACTCACTATAGgtaatttctactaagtgtagat AATTTTAAGGCCGCAAAAGGAGAT (SEQ ID NO: 199): [Target gene information]: Gene ID: 545: Symbol: ATR: Ensembl_Transcript_ID: ENST00000350721.4: GRCh: 37: Chr: 3: [Target cancer mutation information]: mut_start: 142272241: mut_end: 142272241: mut_class: Splice_Site: mut_type: SNP: ref_seq: C: mut_seq: T: mut_aa: FALSE: mutation info source: CCLE: ref_target(-10 +10): TTTTGCGGCCCTAAAATTAAA (SEQ ID NO: 188): mut_target(-10 +10): TTTTGCGGCCTTAAAATTAAA (SEQ ID NO: 189): [Model Cell line information]: cell: A549: cancer_type: LUNG: PAM_dist: 8: indel length: 0: CRISPR gRNA ID: GF-CCELg12-36: [crRNA sequence]: crRNA sequence: TTTTAAGGCCGCAAAAGGAGATTTGGTA (SEQ ID NO: 200): LbgRNA: AATTCTAATACGACTCACTATAGgtaatttctactaagtgtagat AAGGCCGCAAAAGGAGATTTGGTA (SEQ ID NO: 201): [Target gene information]: Gene ID: 545: Symbol: ATR: Ensembl_Transcript_ID: ENST00000350721.4: GRCh: 37: Chr: 3: [Target cancer mutation information]: mut_start: 142272241: mut_end: 142272241: mut_class: Splice_Site: mut_type: SNP: ref_seq: C: mut_seq: T: mut_aa: FALSE: mutation info source: CCLE: ref_target(-10 +10): TTTTGCGGCCCTAAAATTAAA (SEQ ID NO: 188): mut_target(-10 +10): TTTTGCGGCCTTAAAATTAAA (SEQ ID NO: 189): [Model Cell line information]: cell: A549: cancer_type: LUNG: PAM_dist: 2: indel length: 0: CRISPR gRNA ID: GF-CCELg12-37: [crRNA sequence]: crRNA sequence: TTTCCTGCCCAGGCATCCTCCTATTTTT (SEQ ID NO: 202): LbgRNA: AATTCTAATACGACTCACTATAGgtaatttctactaagtgtagat CTGCCCAGGCATCCTCCTATTTT (SEQ ID NO: 203): [Target gene information]: Gene ID: 545: Symbol: ATR: Ensembl_Transcript_ID: ENST00000350721.4: GRCh: 37: Chr: 3: [Target cancer mutation information]: mut_start: 142178136: mut_end: 142178136: mut_class: Missense_Mutation: mut_type: SNP: ref_seq: G: mut_seq: A: mut_aa: p.L2428F: mutation info source: CCLE: ref_target(-10 +10): CTGGGCAGGAGAAATTCTCGG (SEQ ID NO: 204): mut_target(-10 +10): CTGGGCAGGAAAAATTCTCGG (SEQ ID NO: 205): [Model Cell line information]: cell: NCIH661: cancer_type: LUNG: PAM_dist: -2: indel length: 0: CRISPR gRNA ID: GF-CCELg12-38: [crRNA sequence]: crRNA sequence: TTTTTCCTGCCCAGGCATCCTCCTATTT (SEQ ID NO: 206): LbgRNA: AATTCTAATACGACTCACTATAGgtaatttctactaagtgtagat TCCTGCCCAGGCATCCTCCTATTT (SEQ ID NO: 207): [Target gene information]: Gene ID: 545: Symbol: ATR: Ensembl_Transcript_ID: ENST00000350721.4: GRCh: 37: Chr: 3: [Target cancer mutation information]: mut_start: 142178136: mut_end: 142178136: mut_class: Missense_Mutation: mut_type: SNP: ref_seq: G: mut_seq: A: mut_aa: p.L2428F: mutation info source: CCLE: ref_target(-10 +10): CTGGGCAGGAGAAATTCTCGG (SEQ ID NO: 204): mut_target(-10 +10): CTGGGCAGGAAAAATTCTCGG (SEQ ID NO: 205): [Model Cell line information]: cell: NCIH661: cancer_type: LUNG: PAM_dist: 0: indel length: 0: CRISPR gRNA ID: GF-CCELg12-39: [crRNA sequence]: crRNA sequence: TTTCCTGCCCAGGCATCCTCCTATTTT (SEQ ID NO: 208): LbgRNA: AATTCTAATACGACTCACTATAGgtaatttctactaagtgtagat CCTGCCCAGGCATCCTCCTATTTT (SEQ ID NO: 209): [Target gene information]: Gene ID: 545: Symbol: ATR: Ensembl_Transcript_ID: ENST00000350721.4: GRCh: 37: Chr: 3: [Target cancer mutation information]: mut_start: 142178136: mut_end: 142178136: mut_class: Missense_Mutation: mut_type: SNP: ref_seq: G: mut_seq: A: mut_aa: p.L2428F: mutation info source: CCLE: ref_target(-10 +10): CTGGGCAGGAGAAATTCTCGG (SEQ ID NO: 204): mut_target(-10 +10): CTGGGCAGGAAAAATTCTCGG (SEQ ID NO: 205): [Model Cell line information]: cell: NCIH661: cancer_type: LUNG: PAM_dist: -1: indel length: 0: CRISPR gRNA ID: GF-CCELg12-40: [crRNA sequence]: crRNA sequence: TTTCCAATTGCACTGACTCCGGCCACTC (SEQ ID NO: 210): LbgRNA: AATTCTAATACGACTCACTATAGgtaatttctactaagtgtagat CAATTGCACTGACTCCGGCCACTC (SEQ ID NO: 211): [Target gene information]: Gene ID: 545: Symbol: ATR: Ensembl_Transcript_ID: ENST00000350721.4: GRCh: 37: Chr: 3: [Target cancer mutation information]: mut_start: 142224091: mut_end: 142224091: mut_class: Missense_Mutation: mut_type: SNP: ref_seq: T: mut_seq: C: mut_aa: p.R1696G: mutation info source: CCLE: ref_target(-10 +10): TCTGCCTTTCTAATTGCACTG (SEQ ID NO: 212): mut_target(-10 +10): TCTGCCTTTCCAATTGCACTG (SEQ ID NO: 213): [Model Cell line information]: cell: NCIH661: cancer_type: LUNG: PAM_dist: 1: indel length: 0: CRISPR gRNA ID: GF-CCELg12-41: [crRNA sequence]: crRNA sequence: TTTAGAGATGGTTCTGCCTTTCCAATTG (SEQ ID NO: 214): LbgRNA: AATTCTAATACGACTCACTATAGgtaatttctactaagtgtagat GAGATGGTTCTGCCTTTCCAATTG (SEQ ID NO: 215): [Target gene information]: Gene ID: 545: Symbol: ATR: Ensembl_Transcript_ID: ENST00000350721.4: GRCh: 37: Chr: 3: [Target cancer mutation information]: mut_start: 142224091: mut_end: 142224091: mut_class: Missense_Mutation: mut_type: SNP: ref_seq: T: mut_seq: C: mut_aa: p.R1696G: mutation info source: CCLE: ref_target(-10 +10): TCTGCCTTTCTAATTGCACTG (SEQ ID NO: 212): mut_target(-10 +10): TCTGCCTTTCCAATTGCACTG (SEQ ID NO: 213): [Model Cell line information]: cell: NCIH661: cancer_type: LUNG: PAM_dist: 19: indel length: 0: CRISPR gRNA ID: GF-CCELg12-42: [crRNA sequence]: crRNA sequence: TTTTAGAGATGGTTCTGCCTTTCCAATT (SEQ ID NO: 216): LbgRNA: AATTCTAATACGACTCACTATAGgtaatttctactaagtgtagat AGAGATGGTTCTGCCTTTCCAATT (SEQ ID NO: 217): [Target gene information]: Gene ID: 545: Symbol: ATR: Ensembl_Transcript_ID: ENST00000350721.4: GRCh: 37: Chr: 3: [Target cancer mutation information]: mut_start: 142224091: mut_end: 142224091: mut_class: Missense_Mutation: mut_type: SNP: ref_seq: T: mut_seq: C: mut_aa: p.R1696G: mutation info source: CCLE: ref_target(-10 +10): TCTGCCTTTCTAATTGCACTG (SEQ ID NO: 212): mut_target(-10 +10): TCTGCCTTTCCAATTGCACTG (SEQ ID NO: 213): [Model Cell line information]: cell: NCIH661: cancer_type: LUNG: PAM_dist: 20: indel length: 0: CRISPR gRNA ID: GF-CCELg12-43: [crRNA sequence]: crRNA sequence: TTTCCCAGATTTTCAGATGTTAAGTAGA (SEQ ID NO: 218): LbgRNA: AATTCTAATACGACTCACTATAGgtaatttctactaagtgtagat CCAGATTTTCAGATGTTAAGTAGA (SEQ ID NO: 219): [Target gene information]: Gene ID:

TABLE 6-continued

Illustrative guide RNA sequences for Cas12 comprising poylpeptide

546: Symbol: ATRX: Ensembl_Transcript_ID: ENST00000373344.5: GRCh: 37: Chr: X:
[Target cancer mutation information]: mut_start: 76855979: mut_end: 76855979: mut_class:
Missense_Mutation: mut_type: SNP: ref_seq: T: mut_seq: G: mut_aa: p.Q1874P: mutation info
source: CCLE: ref_target(-10 +10): CTGAAAATCTCGGAAAAGCTT (SEQ ID NO: 220):
mut_target(-10 +10): CTGAAAATCTGGGAAAAGCTT (SEQ ID NO: 221): [Model Cell line
information]: cell: NCIH661: cancer_type: LUNG: PAM_dist: 2: indel length: 0: CRISPR gRNA
ID: GF-CCELg12-44: [crRNA sequence]: crRNA sequence:
TTTTCCCAGATTTTCAGATGTTAAGTAG (SEQ ID NO: 222): LbgRNA:
AATTCTAATACGACTCACTATAGgtaatttctactaagtgtagat CCCAGATTTTCAGATGTTAAGTAG
(SEQ ID NO: 223): [Target gene information]: Gene ID: 546: Symbol: ATRX:
Ensembl_Transcript_ID: ENST00000373344.5: GRCh: 37: Chr: X: [Target cancer mutation
information]: mut_start: 76855979: mut_end: 76855979: mut_class: Missense_Mutation:
mut_type: SNP: ref_seq: T: mut_seq: G: mut_aa: p.Q1874P: mutation info source: CCLE:
ref_target(-10 +10): CTGAAAATCTTGGAAAAGCTT (SEQ ID NO: 220): mut_target(-10 +10):
CTGAAAATCTGGGAAAAGCTT (SEQ ID NO: 221): [Model Cell line information]: cell:
NCIH661: cancer_type: LUNG: PAM_dist: 3: indel length: 0: CRISPR gRNA ID: GF-CCELg12-
45: [crRNA sequence]: crRNA sequence: TTTTTTTGCCTTCTTAATCATCTCTTTG (SEQ ID
NO: 224): LbgRNA: AATTCTAATACGACTCACTATAGgtaatttctactaagtgtagat
TTTGCCTTCTTAATCATCTCTTTG (SEQ ID NO: 225): [Target gene information]: Gene ID: 546:
Symbol: ATRX: Ensembl_Transcript_ID: ENST00000373344.5: GRCh: 37: Chr: X: [Target
cancer mutation information]: mut_start: 76939673: mut_end: 76939674: mut_class:
Frame_Shift_Ins: mut_type: INS: ref_seq: -: mut_seq: T: mut_aa: p.L359fs: mutation info
source: CCLE: ref_target(-10 +10): GTCTCAATCA-TTTTTGCCT (SEQ ID NO: 226):
mut_target(-10 +10): GTCTCAATCATTTTTTGCCT (SEQ ID NO: 227): [Model Cell line
information]: cell: HPAFII: cancer_type: PANCREAS: PAM_dist: -3: indel length: 1: CRISPR
gRNA ID: GF-CCELg12-46: [crRNA sequence]: crRNA sequence:
TTTTTTTCCCCTTTTTCCCTTTTTTCTT (SEQ ID NO: 228): LbgRNA:
AATTCTAATACGACTCACTATAGgtaatttctactaagtgtagat TTTCCCCTTTTTCCCTTTTTTCTT
(SEQ ID NO: 229): [Target gene information]: Gene ID: 546: Symbol: ATRX:
Ensembl_Transcript_ID: ENST00000373344.5: GRCh: 37: Chr: X: [Target cancer mutation
information]: mut_start: 76855018: mut_end: 76855019: mut_class: Frame_Shift_Ins: mut_type:
INS: ref_seq: -: mut_seq: T: mut_aa: p.D1940fs: mutation info source: CCLE: ref_target(-10
+10): GAGCTACTAT-TTTTTCCCCT (SEQ ID NO: 230): mut_target(-10 +10):
GAGCTACTATTTTTTTCCCCT (SEQ ID NO: 231): [Model Cell line information]: cell: NCIH661:
cancer_type: LUNG: PAM_dist: -2: indel length: 1: CRISPR gRNA ID: GF-CCELg12-47:
[crRNA sequence]: crRNA sequence: TTTTTTCCCCTTTTTCCCTTTTTTCTTC (SEQ ID NO: 232)
LbgRNA: AATTCTAATACGACTCACTATAGgtaatttctactaagtgtagat
TTCCCCTTTTTCCCTTTTTCTTC (SEQ ID NO: 233): [Target gene information]: Gene ID: 546:
Symbol: ATRX: Ensembl_Transcript_ID: ENST00000373344.5: GRCh: 37: Chr: X: [Target
cancer mutation information]: mut_start: 76855018: mut_end: 76855019: mut_class:
Frame_Shift_Ins: mut_type: INS: ref_seq: -: mut_seq: T: mut_aa: p.D1940fs: mutation info
source: CCLE: ref_target(-10 +10): GAGCTACTAT-TTTTTCCCCT (SEQ ID NO: 230):
mut_target(-10 +10): GAGCTACTATTTTTTTCCCCT (SEQ ID NO: 231): [Model Cell line
information]: cell: NCIH661: cancer_type: LUNG: PAM_dist: -3: indel length: 1: CRISPR
gRNA ID: GF-CCELg12-48: [crRNA sequence]: crRNA sequence:
TTTGGGCAACGAGACAGATCCTCATCAG (SEQ ID NO: 235): LbgRNA:
AATTCTAATACGACTCACTATAGgtaatttctactaagtgtagat GGCAACGAGACAGATCCTCATCAG
(SEQ ID NO: 236): [Target gene information]: Gene ID: 673: Symbol: BRAF:
Ensembl_Transcript_ID: ENST00000288602.6: GRCh: 37: Chr: 7: [Target cancer mutation
information]: mut_start: 140494164: mut_end: 140494164: mut_class: Silent: mut_type: SNP:
ref_seq: G: mut_seq: T: mut_aa: p.R362R: mutation info source: CCLE: ref_target(-10 +10):
GATGAGGATCGGTCTCGTTGC (SEQ ID NO: 237): mut_target(-10 +10):
GATGAGGATCTGTCTCGTTGC (SEQ ID NO: 238): [Model Cell line information]: cell:
NCIH661: cancer_type: LUNG: PAM_dist: 12: indel length: 0: CRISPR gRNA ID: GF-
CCELg12-49: [crRNA sequence]: crRNA sequence: TTTGGCCAACAATACACACATTTTCTG
(SEQ ID NO: 239): LbgRNA: AATTCTAATACGACTCACTATAGgtaatttctactaagtgtagat
GCCAACAATACACACATTTTCTG (SEQ ID NO: 240): [Target gene information]: Gene ID:
672: Symbol: BRCA1: Ensembl_Transcript_ID: ENST00000357654.3: GRCh: 37: Chr: 17:
[Target cancer mutation information]: mut_start: 41234421: mut_end: 41234421: mut_class:
Splice_Site: mut_type: SNP: ref_seq: C: mut_seq: A: mut_aa: p.A14535: mutation info source:
CCLE: ref_target(-10 +10): CAATACACACCTTTTTCTGAT (SEQ ID NO: 241): mut_target(-10
+10): CAATACACACATTTTTCTGAT (SEQ ID NO: 242): [Model Cell line information]: cell:
NCIH1563: cancer_type: LUNG: PAM_dist: 16: indel length: 0: CRISPR gRNA ID: GF-
CCELg12-50: [crRNA sequence]: crRNA sequence: TTTCCACTGCCTGTGGGACTCTCCAACA
(SEQ ID NO: 243): LbgRNA: AATTCTAATACGACTCACTATAGgtaatttctactaagtgtagat
CACTGCCTGTGGGACTCTCCAACA (SEQ ID NO: 244): [Target gene information]: Gene ID:
83990: Symbol: BRIP1: Ensembl_Transcript_ID: ENST00000259008.2: GRCh: 37: Chr: 17:
[Target cancer mutation information]: mut_start: 59937215: mut_end: 59937215: mut_class: Silent:
mut_type: SNP: ref_seq: T: mut_seq: G: mut_aa: p.G49G: mutation info source: CCLE:
ref_target(-10 +10): TTTTTCCACTTCCTGTGGGAC (SEQ ID NO: 245): mut_target(-10 +10):
TTTTTCCACTGCCTGTGGGAC (SEQ ID NO: 246): [Model Cell line information]: cell:
NCIH1975: cancer_type: LUNG: PAM_dist: 5: indel length: 0: CRISPR gRNA ID: GF-
CCELg12-51: [crRNA sequence]: crRNA sequence: TTTTTCCACTGCCTGTGGGACTCTCCAA
(SEQ ID NO: 247): LbgRNA: AATTCTAATACGACTCACTATAGgtaatttctactaagtgtagat
TCCACTGCCTGTGGGACTCTCCAA (SEQ ID NO: 248): [Target gene information]: Gene ID:
83990: Symbol: BRIP1: Ensembl_Transcript_ID: ENST00000259008.2: GRCh: 37: Chr: 17:
[Target cancer mutation information]: mut_start: 59937215: mut_end: 59937215: mut_class: Silent:
mut_type: SNP: ref_seq: T: mut_seq: G: mut_aa: p.G49G: mutation info source: CCLE:

TABLE 6-continued

Illustrative guide RNA sequences for Cas12 comprising poylpeptide ref_target(-10 +10): TTTTTCCACTTCCTGTGGGAC (SEQ ID NO: 245): mut_target(-10 +10):
TTTTTCCACTGCCTGTGGGAC (SEQ ID NO: 246): [Model Cell line information]: cell:
NCIH1975: cancer_type: LUNG: PAM_dist: 7: indel length: 0: CRISPR gRNA ID: GF-
CCELg12-52: [crRNA sequence]: crRNA sequence: TTTTCCACTGCCTGTGGGACTCTCCAAC
(SEQ ID NO: 249): LbgRNA: AATTCTAATACGACTCACTATAGgtaatttctactaagtgtagat
CCACTGCCTGTGGGACTCTCCAAC (SEQ ID NO: 250): [Target gene information]: Gene ID:
83990: Symbol: BRIP1: Ensembl_Transcript_ID: ENST00000259008.2: GRCh: 37: Chr: 17:
[Target cancer mutation information]: mut_start: 59937215: mut_end: 59937215: mut_class: Silent:
mut_type: SNP: ref_seq: T: mut_seq: G: mut_aa: p.G49G: mutation info source: CCLE:
ref_target(-10 +10): TTTTTCCACTTCCTGTGGGAC (SEQ ID NO: 245): mut_target(-10 +10):
TTTTTCCACTGCCTGTGGGAC (SEQ ID NO: 246): [Model Cell line information]: cell:
NCIH1975: cancer_type: LUNG: PAM_dist: 6: indel length: 0: CRISPR gRNA ID: GF-
CCELg12-53: [crRNA sequence]: crRNA sequence: TTTGTTGGAGAGTCCCACAGGCAGTGGA
(SEQ ID NO: 251): LbgRNA: AATTCTAATACGACTCACTATAGgtaatttctactaagtgtagat
TTGGAGAGTCCCACAGGCAGTGGA (SEQ ID NO: 252): [Target gene information]: Gene ID:
83990: Symbol: BRIP1: Ensembl_Transcript_ID: ENST00000259008.2: GRCh: 37: Chr: 17:
[Target cancer mutation information]: mut_start: 59937215: mut_end: 59937215: mut_class: Silent:
mut_type: SNP: ref_seq: T: mut_seq: G: mut_aa: p.G49G: mutation info source: CCLE:
ref_target(-10 +10): TTTTTCCACTTCCTGTGGGAC (SEQ ID NO: 245): mut_target(-10 +10):
TTTTTCCACTGCCTGTGGGAC (SEQ ID NO: 246): [Model Cell line information]: cell:
NCIH1975: cancer_type: LUNG: PAM_dist: 18: indel length: 0: CRISPR gRNA ID: GF-
CCELg12-54: [crRNA sequence]: crRNA sequence: TTTCAAAGGTTGAATGGTGCGAATCTGC
(SEQ ID NO: 253): LbgRNA: AATTCTAATACGACTCACTATAGgtaatttctactaagtgtagat
AAAGGTTGAATGGTGCGAATCTGC (SEQ ID NO: 254): [Target gene information]: Gene ID:
83990: Symbol: BRIP1: Ensembl_Transcript_ID: ENST00000259008.2: GRCh: 37: Chr: 17:
[Target cancer mutation information]: mut_start: 59763496: mut_end: 59763496: mut_class:
Frame_Shift_Del: mut_type: DEL: ref_seq: T: mut_seq: -: mut_aa: p.Q869fs: mutation info
source: CCLE: ref_target(-10 +10): TGAATGGTGCTGAATCTGCTG (SEQ ID NO: 255):
mut_target(-10 +10): TGAATGGTGC-GAATCTGCTG (SEQ ID NO: 256): [Model Cell line
information]: cell: NCIH1573: cancer_type: LUNG: PAM_dist: 17: indel length: 1: CRISPR
gRNA ID: GF-CCELg12-55: [crRNA sequence]: crRNA sequence:
TTTCTAAATGGGTACGGCAGCAGATTCG     (SEQ ID NO: 257): LbgRNA:
AATTCTAATACGACTCACTATAGgtaatttctactaagtgtagat TAAATGGGTACGGCAGCAGATTCG
(SEQ ID NO: 258): [Target gene information]: Gene ID: 83990: Symbol: BRIP1:
Ensembl_Transcript_ID: ENST00000259008.2: GRCh: 37: Chr: 17: [Target cancer mutation
information]: mut_start: 59763496: mut_end: 59763496: mut_class: Frame_Shift_Del: mut_type:
DEL: ref_seq: T: mut_seq: -: mut_aa: p.Q869fs: mutation info source: CCLE: ref_target(-10
+10): TGAATGGTGCTGAATCTGCTG (SEQ ID NO: 255): mut_target(-10 +10):
TGAATGGTGC-GAATCTGCTG (SEQ ID NO: 256): [Model Cell line information]: cell:
NCIH1573: cancer_type: LUNG: PAM_dist: 24: indel length: 1: CRISPR gRNA ID: GF-
CCELg12-56: [crRNA sequence]: crRNA sequence: TTTGATCCTAGAGGGGGTGGCAGCCTGT
(SEQ ID NO: 259): LbgRNA: AATTCTAATACGACTCACTATAGgtaatttctactaagtgtagat
ATCCTAGAGGGGGTGGCAGCCTGT (SEQ ID NO: 260): [Target gene information]: Gene ID:
867: Symbol: CBL: Ensembl_Transcript_ID: ENST00000264033.4: GRCh: 37: Chr: 11: [Target
cancer mutation information]: mut_start: 119149307: mut_end: 119149307: mut_class:
Missense_Mutation: mut_type: SNP: ref_seq: A: mut_seq: G: mut_aa: p.S439G: mutation info
source: CCLE: ref_target(-10 +10): TCCTAGAGGGAGTGGCAGCCT (SEQ ID NO: 261):
mut_target(-10 +10): TCCTAGAGGGGGTGGCAGCCT (SEQ ID NO: 262): [Model Cell line
information]: cell: NCIH1563: cancer_type: LUNG: PAM_dist: 12: indel length: 0: CRISPR
gRNA ID: GF-CCELg12-57: [crRNA sequence]: crRNA sequence:
TTTCACCGAAGGCCGGAACCAGGGCAGC (SEQ ID NO: 263): LbgRNA:
AATTCTAATACGACTCACTATAGgtaatttctactaagtgtagat ACCGAAGGCCGGAACCAGGGCAGC
(SEQ ID NO: 264): [Target gene information]: Gene ID: 80381: Symbol: CD276:
Ensembl_Transcript_ID: ENST00000318443.5: GRCh: 37: Chr: 15: [Target cancer mutation
information]: mut_start: 73996170: mut_end: 73996170: mut_class: Missense_Mutation:
mut_type: SNP: ref_seq: G: mut_seq: A: mut_aa: p.D302N: mutation info source: CCLE:
ref_target(-10 +10): CGAAGGCCGGGACCAGGCAG (SEQ ID NO: 265): mut_target(-10 +10):
CGAAGGCCGGAACCAGGGCAG (SEQ ID NO: 266): [Model Cell line information]: cell:
NCIH1573: cancer_type: LUNG: PAM_dist: 13: indel length: 0: CRISPR gRNA ID: GF-
CCELg12-58: [crRNA sequence]: crRNA sequence: TTTGGAGGACAATAATATATGTCCCAAG
(SEQ ID NO: 267): LbgRNA: AATTCTAATACGACTCACTATAGgtaatttctactaagtgtagat
GAGGACAATAATATATGTCCCAAG (SEQ ID NO: 268): [Target gene information]: Gene ID:
64326: Symbol: RFWD2: Ensembl_Transcript_ID: ENST00000367669.3: GRCh: 37: Chr: 1:
[Target cancer mutation information]: mut_start: 176145105: mut_end: 176145105: mut_class:
Missense_Mutation: mut_type: SNP: ref_seq: C: mut_seq: A: mut_aa: p.R169I: mutation info
source: CCLE: ref_target(-10 +10): CTTGGGACATCTATTATTGTC (SEQ ID NO: 269):
mut_target(-10 +10): CTTGGGACATATATTATTGTC (SEQ ID NO: 270): [Model Cell line
information]: cell: NCIH1563: cancer_type: LUNG: PAM_dist: 14: indel length: 0: CRISPR
gRNA ID: GF-CCELg12-59: [crRNA sequence]: crRNA sequence:
TTTATCCAATATTATTTCTACTTCTTGT (SEQ ID NO: 271): LbgRNA:
AATTCTAATACGACTCACTATAGgtaatttctactaagtgtagat TCCAATATTATTTCTACTTCTTGT
(SEQ ID NO: 272): [Target gene information]: Gene ID: 8452: Symbol: CUL3:
Ensembl_Transcript_ID: ENST00000264414.4: GRCh: 37: Chr: 2: [Target cancer mutation
information]: mut_start: 225368517: mut_end: 225368517: mut_class: Missense_Mutation:
mut_type: SNP: ref_seq: G: mut_seq: A: mut_aa: p.T410I: mutation info source: CCLE:
ref_target(-10 +10): ATCCAATATTGTTTCTACTTC (SEQ ID NO: 273): mut_target(-10 +10):
ATCCAATATTATTTCTACTTC (SEQ ID NO: 274): [Model Cell line information]: cell: NCIH460:
cancer_type: LUNG: PAM_dist: 10: indel length: 0: CRISPR gRNA ID: GF-CCELg12-60:

TABLE 6-continued

Illustrative guide RNA sequences for Cas12 comprising poylpeptide

[crRNA sequence]: crRNA sequence: TTTCAGGGACAAATGTGCTGTGCTTACA (SEQ ID NO: 275): LbgRNA: AATTCTAATACGACTCACTATAGgtaatttctactaagtgtagat AGGGACAAATGTGCTGTGCTTACA (SEQ ID NO: 276): [Target gene information]: Gene ID: 23405: Symbol: DICER1: Ensembl_Transcript_ID: ENST00000526495.1: GRCh: 37: Chr: 14: [Target cancer mutation information]: mut_start: 95570354: mut_end: 95570354: mut_class: Missense_Mutation: mut_type: SNP: ref_seq: T: mut_seq: A: mut_aa: p.I1127F: mutation info source: CCLE: ref_target(-10 +10): TCAGGGACAATTGTGCTGTGC (SEQ ID NO: 277): mut_target(-10 +10): TCAGGGACAAATGTGCTGTGC (SEQ ID NO: 278): [Model Cell line information]: cell: NCIH1975: cancer_type: LUNG: PAM_dist: 9: indel length: 0: CRISPR gRNA ID: GF-CCELg12-61: [crRNA sequence]: crRNA sequence: TTTTCAGGGACAAATGTGCTGTGCTTAC (SEQ ID NO: 279): LbgRNA: AATTCTAATACGACTCACTATAGgtaatttctactaagtgtagat CAGGGACAAATGTGCTGTGCTTAC (SEQ ID NO: 280): [Target gene information]: Gene ID: 23405: Symbol: DICER1: Ensembl_Transcript_ID: ENST00000526495.1: GRCh: 37: Chr: 14: [Target cancer mutation information]: mut_start: 95570354: mut_end: 95570354: mut_class: Missense_Mutation: mut_type: SNP: ref_seq: T: mut_seq: A: mut_aa: p.I1127F: mutation info source: CCLE: ref_target(-10 +10): TCAGGGACAATTGTGCTGTGC (SEQ ID NO: 277): mut_target(-10 +10): TCAGGGACAAATGTGCTGTGC (SEQ ID NO: 278): [Model Cell line information]: cell: NCIH1975: cancer_type: LUNG: PAM_dist: 0: indel length: 0: CRISPR gRNA ID: GF-CCELg12-62: [crRNA sequence]: crRNA sequence: TTTGTCCCTGAAAATGCTGCACATCAAG (SEQ ID NO: 281): LbgRNA: AATTCTAATACGACTCACTATAGgtaatttctactaagtgtagat TCCCTGAAAATGCTGCACATCAAG (SEQ ID NO: 282): [Target gene information]: Gene ID: 23405: Symbol: DICER1: Ensembl_Transcript_ID: ENST00000526495.1: GRCh: 37: Chr: 14: [Target cancer mutation information]: mut_start: 95570354: mut_end: 95570354: mut_class: Missense_Mutation: mut_type: SNP: ref_seq: T: mut_seq: A: mut_aa: p.I1127F: mutation info source: CCLE: ref_target(-10 +10): TCAGGGACAATTGTGCTGTGC (SEQ ID NO: 277): mut_target(-10 +10): TCAGGGACAAATGTGCTGTGC (SEQ ID NO: 278): [Model Cell line information]: cell: NCIH1975: cancer_type: LUNG: PAM_dist: -3: indel length: 0: CRISPR gRNA ID: GF-CCELg12-63: [crRNA sequence]: crRNA sequence: TTTGTCTGCTCACCAAGAAGTTCATTCA (SEQ ID NO: 283): LbgRNA: AATTCTAATACGACTCACTATAGgtaatttctactaagtgtagat TCTGCTCACCAAGAAGTTCATTCA (SEQ ID NO: 284): [Target gene information]: Gene ID: 1871: Symbol: E2F3: Ensembl_Transcript_ID: ENST00000346618.3: GRCh: 37: Chr: 6: [Target cancer mutation information]: mut_start: 20481481: mut_end: 20481481: mut_class: Missense_Mutation: mut_type: SNP: ref_seq: G: mut_seq: T: mut_aa: p.G184C: mutation info source: CCLE: ref_target(-10 +10): TACGTCTCTTGGTCTGCTCAC (SEQ ID NO: 285): mut_target(-10 +10): TACGTCTCTTTGTCTGCTCAC (SEQ ID NO: 286): [Model Cell line information]: cell: NCIH2126: cancer_type: LUNG: PAM_dist: -1: indel length: 0: CRISPR gRNA ID: GF-CCELg12-64: [crRNA sequence]: crRNA sequence: TTTGGGCGGGCCAAACTGCTGGGTGCGG (SEQ ID NO: 287): LbgRNA: AATTCTAATACGACTCACTATAGgtaatttctactaagtgtagat GGCGGGCCAAACTGCTGGGTGCGG (SEQ ID NO: 288): [Target gene information]: Gene ID: 1956: Symbol: EGFR: Ensembl_Transcript_ID: ENST00000275493.2: GRCh: 37: Chr: 7: [Target cancer mutation information]: mut_start: 55259515: mut_end: 55259515: mut_class: Missense_Mutation: mut_type: SNP: ref_seq: T: mut_seq: G: mut_aa: p.L858R: mutation info source: CCLE: ref_target(-10 +10): GATTTTGGGCTGGCCAAACTG (SEQ ID NO: 289): mut_target(-10 +10): GATTTTGGGCGGGCCAAACTG (SEQ ID NO: 290): [Model Cell line information]: cell: NCIH1975: cancer_type: LUNG: PAM_dist: 4: indel length: 0: CRISPR gRNA ID: GF-CCELg12-65: [crRNA sequence]: crRNA sequence: TTTTGGGCGGGCCAAACTGCTGGGTGCG (SEQ ID NO: 291): LbgRNA: AATTCTAATACGACTCACTATAGgtaatttctactaagtgtagat GGGCGGGCCAAACTGCTGGGTGCG (SEQ ID NO: 292): [Target gene information]: Gene ID: 1956: Symbol: EGFR: Ensembl_Transcript_ID: ENST00000275493.2: GRCh: 37: Chr: 7: [Target cancer mutation information]: mut_start: 55259515: mut_end: 55259515: mut_class: Missense_Mutation: mut_type: SNP: ref_seq: T: mut_seq: G: mut_aa: p.L858R: mutation info source: CCLE: ref_target(-10 +10): GATTTTGGGCTGGCCAAACTG (SEQ ID NO: 289): mut_target(-10 +10): GATTTTGGGCGGGCCAAACTG (SEQ ID NO: 290): [Model Cell line information]: cell: NCIH1975: cancer_type: LUNG: PAM_dist: 5: indel length: 0: CRISPR gRNA ID: GF-CCELg12-66: [crRNA sequence]: crRNA sequence: TTTGGCCCGCCCAAAATCTGTGATCTTG (SEQ ID NO: 293): LbgRNA: AATTCTAATACGACTCACTATAGgtaatttctactaagtgtagat GCCCGCCCAAAATCTGTGATCTTG (SEQ ID NO: 294): [Target gene information]: Gene ID: 1956: Symbol: EGFR: Ensembl_Transcript_ID: ENST00000275493.2: GRCh: 37: Chr: 7: [Target cancer mutation information]: mut_start: 55259515: mut_end: 55259515: mut_class: Missense_Mutation: mut_type: SNP: ref_seq: T: mut_seq: G: mut_aa: p.L858R: mutation info source: CCLE: ref_target(-10 +10): GATTTTGGGCTGGCCAAACTG (SEQ ID NO: 289): mut_target(-10 +10): GATTTTGGGCGGGCCAAACTG (SEQ ID NO: 290): [Model Cell line information]: cell: NCIH1975: cancer_type: LUNG: PAM_dist: 4: indel length: 0: CRISPR gRNA ID: GF-CCELg12-67: [crRNA sequence]: crRNA sequence: TTTCCTTGTTGGCTTTCGGAGATGTTT (SEQ ID NO: 295): LbgRNA: AATTCTAATACGACTCACTATAGgtaatttctactaagtgtagat CTTGTTGGCTTTCGGAGATGTTTT (SEQ ID NO: 296): [Target gene information]: Gene ID: 1956: Symbol: EGFR: Ensembl_Transcript_ID: ENST00000275493.2: GRCh: 37: Chr: 7: [Target cancer mutation information]: mut_start: 55242465: mut_end: 55242479: mut_class: In_Frame_Del: mut_type: DEL: ref_seq: GGAATTAAGAGAAGC (SEQ ID NO: 86): mut_seq: -: mut_aa: p.ELREA746del ("ELREA" disclosed as SEQ ID NO: 87): mutation info source: CCLE: ref_target(-10 +10): TCGCTATCAAGGAATTAAGAGAAGCAACATCTCCG (SEQ ID NO: 91): mut_target(-10 +10): TCGCTATCAA---------------AACATCTCCG (SEQ ID NO: 94): [Model Cell line information]: cell:

TABLE 6-continued

Illustrative guide RNA sequences for Cas12 comprising poylpeptide

NCIH1650: cancer_type: LUNG: PAM_dist: 23: indel length: 15: CRISPR gRNA ID: GF-
CCELg12-68: [crRNA sequence]: crRNA sequence: TTTCGGAGATGTTTTGATAGCGACGGGA
(SEQ ID NO: 297): LbgRNA: AATTCTAATACGACTCACTATAGgtaatttctactaagtgtagat
GGAGATGTTTTGATAGCGACGGGA (SEQ ID NO: 298): [Target gene information]: Gene ID:
1956: Symbol: EGFR: Ensembl_Transcript_ID: ENST00000275493.2: GRCh: 37: Chr: 7:
[Target cancer mutation information]: mut_start: 55242465: mut_end: 55242479: mut_class:
In_Frame_Del: mut_type: DEL: ref_seq: GGAATTAAGAGAAGC (SEQ ID NO: 86): mut_seq: -:
mut_aa: p.ELREA746del ("ELREA" disclosed as SEQ ID NO: 87): mutation info source: CCLE:
ref_target(-10 +10): TCGCTATCAAGGAATTAAGAGAAGCAACATCTCCG (SEQ ID NO: 91):
mut_target(-10 +10): TCGCTATCAA---------------AACATCTCCG (SEQ ID NO: 94): [Model Cell
line information]: cell: NCIH1650: cancer_type: LUNG: PAM_dist: 10: indel length: 15:
CRISPR gRNA ID: GF-CCELg12-69: [crRNA sequence]: crRNA sequence:
TTTGATAGCGACGGGAATTTTAACTTTC (SEQ ID NO: 88): LbgRNA:
AATTCTAATACGACTCACTATAGgtaatttctactaagtgtagat ATAGCGACGGGAATTTTAACTTTC
(SEQ ID NO: 97): [Target gene information]: Gene ID: 1956: Symbol: EGFR:
Ensembl_Transcript_ID: ENST00000275493.2: GRCh: 37: Chr: 7: [Target cancer mutation
information]: mut_start: 55242465: mut_end: 55242479: mut_class: In_Frame_Del: mut_type:
DEL: ref_seq: GGAATTAAGAGAAGC (SEQ ID NO: 86): mut_seq: -: mut_aa: p.ELREA746del
("ELREA" disclosed as SEQ ID NO: 87): mutation info source: CCLE: ref_target(-10 +10):
TCGCTATCAAGGAATTAAGAGAAGCAACATCTCCG (SEQ ID NO: 91): mut_target(-10 +10):
TCGCTATCAA---------------AACATCTCCG (SEQ ID NO: 94): [Model Cell line information]: cell:
NCIH1650: cancer_type: LUNG: PAM_dist: -2: indel length: 15: CRISPR gRNA ID: GF-
CCELg12-70: [crRNA sequence]: crRNA sequence: TTTTGATAGCGACGGGAATTTTAACTTTT
(SEQ ID NO: 299): LbgRNA: AATTCTAATACGACTCACTATAGgtaatttctactaagtgtagat
GATAGCGACGGGAATTTTAACTTT (SEQ ID NO: 300): [Target gene information]: Gene ID:
1956: Symbol: EGFR: Ensembl_Transcript_ID: ENST00000275493.2: GRCh: 37: Chr: 7:
[Target cancer mutation information]: mut_start: 55242465: mut_end: 55242479: mut_class:
In_Frame_Del: mut_type: DEL: ref_seq: GGAATTAAGAGAAGC (SEQ ID NO: 86): mut_seq: -:
mut_aa: p.ELREA746del ("ELREA" disclosed as SEQ ID NO: 87): mutation info source: CCLE:
ref_target(-10 +10): TCGCTATCAAGGAATTAAGAGAAGCAACATCTCCG (SEQ ID NO: 91):
mut_target(-10 +10): TCGCTATCAA---------------AACATCTCCG (SEQ ID NO: 94): [Model Cell
line information]: cell: NCIH1650: cancer_type: LUNG: PAM_dist: -1: indel length: 15:
CRISPR gRNA ID: GF-CCELg12-71: [crRNA sequence]: crRNA sequence:
TTTCCTTGTTGGCTTTCGGAGATGTCTT (SEQ ID NO: 301): LbgRNA:
AATTCTAATACGACTCACTATAGgtaatttctactaagtgtagat CTTGTTGGCTTTCGGAGATGTCTT
(SEQ ID NO: 302): [Target gene information]: Gene ID: 1956: Symbol: EGFR:
Ensembl_Transcript_ID: ENST00000275493.2: GRCh: 37: Chr: 7: [Target cancer mutation
information]: mut_start: 55242466: mut_end: 55242480: mut_class: In_Frame_Del: mut_type:
DEL: ref_seq: GAATTAAGAGAAGCA (SEQ ID NO: 100): mut_seq: -: mut_aa: p.ELREA746del
("ELREA" disclosed as SEQ ID NO: 87): mutation info source: CCLE: ref_target(-10 +10):
CGCTATCAAGGAATTAAGAGAAGCAACATCTCCGA (SEQ ID NO: 104): mut_target(-10
+10): CGCTATCAAG---------------ACATCTCCGA (SEQ ID NO: 107): [Model Cell line
information]: cell: HCC827: cancer_type: LUNG: PAM_dist: 22: indel length: 15: CRISPR
gRNA ID: GF-CCELg12-72: [crRNA sequence]: crRNA sequence:
TTTCGGAGATGTCTTGATAGCGACGGGA (SEQ ID NO: 303): LbgRNA:
AATTCTAATACGACTCACTATAGgtaatttctactaagtgtagat GGAGATGTCTTGATAGCGACGGGA
(SEQ ID NO: 304): [Target gene information]: Gene ID: 1956: Symbol: EGFR:
Ensembl_Transcript_ID: ENST00000275493.2: GRCh: 37: Chr: 7: [Target cancer mutation
information]: mut_start: 55242466: mut_end: 55242480: mut_class: In_Frame_Del: mut_type:
DEL: ref_seq: GAATTAAGAGAAGCA (SEQ ID NO: 100): mut_seq: -: mut_aa: p.ELREA746del
("ELREA" disclosed as SEQ ID NO: 87): mutation info source: CCLE: ref_target(-10 +10):
CGCTATCAAGGAATTAAGAGAAGCAACATCTCCGA (SEQ ID NO: 104): mut_target(-10
+10): CGCTATCAAG---------------ACATCTCCGA (SEQ ID NO: 107): [Model Cell line
information]: cell: HCC827: cancer_type: LUNG: PAM_dist: 9: indel length: 15: CRISPR gRNA
ID: GF-CCELg12-73: [crRNA sequence]: crRNA sequence:
TTTCCTTGTTGGCTTTCGGAGATGTCTT (SEQ ID NO: 301): LbgRNA:
AATTCTAATACGACTCACTATAGgtaatttctactaagtgtagat CTTGTTGGCTTTCGGAGATGTCTT
(SEQ ID NO: 302): [Target gene information]: Gene ID: 1956: Symbol: EGFR:
Ensembl_Transcript_ID: ENST00000275493.2: GRCh: 37: Chr: 7: [Target cancer mutation
information]: mut_start: 55242466: mut_end: 55242480: mut_class: In_Frame_Del: mut_type:
DEL: ref_seq: GAATTAAGAGAAGCA (SEQ ID NO: 100): mut_seq: -: mut_aa: p.ELREA746del
("ELREA" disclosed as SEQ ID NO: 87): mutation info source: CCLE: ref_target(-10 +10):
CGCTATCAAGGAATTAAGAGAAGCAACATCTCCGA (SEQ ID NO: 104): mut_target(-10
+10): CGCTATCAAG---------------ACATCTCCGA (SEQ ID NO: 107): [Model Cell line
information]: cell: HCC827GR5: cancer_type: LUNG: PAM_dist: 22: indel length: 15: CRISPR
gRNA ID: GF-CCELg12-74: [crRNA sequence]: crRNA sequence:
TTTCGGAGATGTCTTGATAGCGACGGGA (SEQ ID NO: 303): LbgRNA:
AATTCTAATACGACTCACTATAGgtaatttctactaagtgtagat GGAGATGTCTTGATAGCGACGGGA
(SEQ ID NO: 304): [Target gene information]: Gene ID: 1956: Symbol: EGFR:
Ensembl_Transcript_ID: ENST00000275493.2: GRCh: 37: Chr: 7: [Target cancer mutation
information]: mut_start: 55242466: mut_end: 55242480: mut_class: In_Frame_Del: mut_type:
DEL: ref_seq: GAATTAAGAGAAGCA (SEQ ID NO: 100): mut_seq: -: mut_aa: p.ELREA746del
("ELREA" disclosed as SEQ ID NO: 87): mutation info source: CCLE: ref_target(-10 +10):
CGCTATCAAGGAATTAAGAGAAGCAACATCTCCGA (SEQ ID NO: 104): mut_target(-10
+10): CGCTATCAAG---------------ACATCTCCGA (SEQ ID NO: 107): [Model Cell line
information]: cell: HCC827GR5: cancer_type: LUNG: PAM_dist: 9: indel length: 15: CRISPR TABLE 6-continued Illustrative guide RNA sequences for Cas12 comprising poylpeptide gRNA ID: GF-CCELg12-75: [crRNA sequence]: crRNA sequence:
TTTAAATTCTTTACAGTGCACTTCAAAA (SEQ ID NO: 305): LbgRNA:
AATTCTAATACGACTCACTATAGgtaatttctactaagtgtagat AATTCTTTACAGTGCACTTCAAAA
(SEQ ID NO: 306): [Target gene information]: Gene ID: 4072: Symbol: EPCAM
Ensembl_Transcript_ID: ENST00000263735.4: GRCh: 37: Chr: 2: [Target cancer mutation
information]: mut_start: 47604162: mut_end: 47604162: mut_class: Silent: mut_type: SNP:
ref_seq: G: mut_seq: A: mut_aa: p.Q167Q: mutation info source: CCLE: ref_target(-10 +10):
GTGCACTTCAGAAGGAGATCA (SEQ ID NO: 307): mut_target(-10 +10):
GTGCACTTCAAAAGGAGATCA (SEQ ID NO: 308): [Model Cell line information]: cell:
NCIH1975: cancer_type: LUNG: PAM_dist: 22: indel length: 0: CRISPR gRNA ID: GF-
CCELg12-76: [crRNA sequence]: crRNA sequence: TTTACAGTGCACTTCAAAAGGAGATCAC
(SEQ ID NO: 309): LbgRNA: AATTCTAATACGACTCACTATAGgtaatttctactaagtgtagat
CAGTGCACTTCAAAAGGAGATCAC (SEQ ID NO: 310): [Target gene information]: Gene ID:
4072: Symbol: EPCAM: Ensembl_Transcript_ID: ENST00000263735.4: GRCh: 37: Chr: 2:
[Target cancer mutation information]: mut_start: 47604162: mut_end: 47604162: mut_class: Silent:
mut_type: SNP: ref_seq: G: mut_seq: A: mut_aa: p.Q167Q: mutation info source: CCLE:
ref_target(-10 +10): GTGCACTTCAGAAGGAGATCA (SEQ ID NO: 307): mut_target(-10 +10)
GTGCACTTCAAAAGGAGATCA (SEQ ID NO: 308): [Model Cell line information]: cell:
NCIH1975: cancer_type: LUNG: PAM_dist: 13: indel length: 0: CRISPR gRNA ID: GF-
CCELg12-77: [crRNA sequence]: crRNA sequence: TTTTAAATTCTTTACAGTGCACTTCAAA
(SEQ ID NO: 311): LbgRNA: AATTCTAATACGACTCACTATAGgtaatttctactaagtgtagat
AAATTCTTTACAGTGCACTTCAAA (SEQ ID NO: 312): [Target gene information]: Gene ID:
4072: Symbol: EPCAM: Ensembl_Transcript_ID: ENST00000263735.4: GRCh: 37: Chr: 2:
[Target cancer mutation information]: mut_start: 47604162: mut_end: 47604162: mut_class: Silent:
mut_type: SNP: ref_seq: G: mut_seq: A: mut_aa: p.Q167Q: mutation info source: CCLE:
ref_target(-10 +10): GTGCACTTCAGAAGGAGATCA (SEQ ID NO: 307): mut_target(-10 +10):
GTGCACTTCAAAAGGAGATCA (SEQ ID NO: 308): [Model Cell line information]: cell:
NCIH1975: cancer_type: LUNG: PAM_dist: 23: indel length: 0: CRISPR gRNA ID: GF-
CCELg12-78: [crRNA sequence]: crRNA sequence: TTTGAAGTGCACTGTAAAGAATTTAAAA
(SEQ ID NO: 313): LbgRNA: AATTCTAATACGACTCACTATAGgtaatttctactaagtgtagat
AAGTGCACTGTAAAGAATTTAAAA (SEQ ID NO: 314): [Target gene information]: Gene ID:
4072: Symbol: EPCAM: Ensembl_Transcript_ID: ENST00000263735.4: GRCh: 37: Chr: 2:
[Target cancer mutation information]: mut_start: 47604162: mut_end: 47604162: mut_class: Silent:
mut_type: SNP: ref_seq: G: mut_seq: A: mut_aa: p.Q167Q: mutation info source: CCLE:
ref_target(-10 +10): GTGCACTTCAGAAGGAGATCA (SEQ ID NO: 307): mut_target(-10 +10)
GTGCACTTCAAAAGGAGATCA (SEQ ID NO: 308): [Model Cell line information]: cell:
NCIH1975: cancer_type: LUNG: PAM_dist: -2: indel length: 0: CRISPR gRNA ID: GF-
CCELg12-79: [crRNA sequence]: crRNA sequence: TTTTGAAGTGCACTGTAAAGAATTTAAA
(SEQ ID NO: 315): LbgRNA: AATTCTAATACGACTCACTATAGgtaatttctactaagtgtagat
GAAGTGCACTGTAAAGAATTTAAA (SEQ ID NO: 316): [Target gene information]: Gene ID:
4072: Symbol: EPCAM: Ensembl_Transcript_ID: ENST00000263735.4: GRCh: 37: Chr: 2:
[Target cancer mutation information]: mut_start: 47604162: mut_end: 47604162: mut_class: Silent:
mut_type: SNP: ref_seq: G: mut_seq: A: mut_aa: p.Q167Q: mutation info source: CCLE:
ref_target(-10 +10): GTGCACTTCAGAAGGAGATCA (SEQ ID NO: 307): mut_target(-10 +10):
GTGCACTTCAAAAGGAGATCA (SEQ ID NO: 308): [Model Cell line information]: cell:
NCIH1975: cancer_type: LUNG: PAM_dist: -1: indel length: 0: CRISPR gRNA ID: GF-
CCELg12-80: [crRNA sequence]: crRNA sequence: TTTCTGATTTCGAACTTTCGCGTGTCCT
(SEQ ID NO: 317): LbgRNA: AATTCTAATACGACTCACTATAGgtaatttctactaagtgtagat
TGATTTCGAACTTTCGCGTGTCCT (SEQ ID NO: 318): [Target gene information]: Gene ID:
2042: Symbol: EPHA3: Ensembl_Transcript_ID: ENST00000336596.2: GRCh: 37: Chr: 3:
[Target cancer mutation information]: mut_start: 89480460: mut_end: 89480460: mut_class:
Missense_Mutation: mut_type: SNP: ref_seq: G: mut_seq: A: mut_aa: p.G766E: mutation info
source: CCLE: ref_target(-10 +10): TCTGATTTCGGACTTTCGCGT (SEQ ID NO: 319):
mut_target(-10 +10): TCTGATTTCGAACTTTCGCGT (SEQ ID NO: 320): [Model Cell line
information]: cell: NCIH2126: cancer_type: LUNG: PAM_dist: 9: indel length: 0: CRISPR
gRNA ID: GF-CCELg12-81: [crRNA sequence]: crRNA sequence:
TTTCGAACTTTCGCGTGTCCTGGAGGAT (SEQ ID NO: 321): LbgRNA:
AATTCTAATACGACTCACTATAGgtaatttctactaagtgtagat GAACTTTCGCGTGTCCTGGAGGAT
(SEQ ID NO: 322): [Target gene information]: Gene ID: 2042: Symbol: EPHA3:
Ensembl_Transcript_ID: ENST00000336596.2: GRCh: 37: Chr: 3: [Target cancer mutation
information]: mut_start: 89480460: mut_end: 89480460: mut_class: Missense_Mutation:
mut_type: SNP: ref_seq: G: mut_seq: A: mut_aa: p.G766E: mutation info source: CCLE:
ref_target(-10 +10): TCTGATTTCGGACTTTCGCGT (SEQ ID NO: 319): mut_target(-10 +10):
TCTGATTTCGAACTTTCGCGT (SEQ ID NO: 320): [Model Cell line information]: cell:
NCIH2126: cancer_type: LUNG: PAM_dist: 2: indel length: 0: CRISPR gRNA ID: GF-
CCELg12-82: [crRNA sequence]: crRNA sequence: TTTGCACACAAGGTTACTGTTGTTTAAG
(SEQ ID NO: 323): LbgRNA: AATTCTAATACGACTCACTATAGgtaatttctactaagtgtagat
CACACAAGGTTACTGTTGTTTAAG (SEQ ID NO: 324): [Target gene information]: Gene ID:
2044: Symbol: EPHA5: Ensembl_Transcript_ID: ENST00000273854.3: GRCh: 37: Chr: 4:
[Target cancer mutation information]: mut_start: 66217192: mut_end: 66217192: mut_class:
Missense_Mutation: mut_type: SNP: ref_seq: A: mut_seq: T: mut_aa: p.I808N: mutation info
source: CCLE: ref_target(-10 +10): GTTACTGTTGATTAAGATGTT (SEQ ID NO: 325):
mut_target(-10 +10): GTTACTGTTGTTTAAGATGTT (SEQ ID NO: 326): [Model Cell line
information]: cell: NCIH1573: cancer_type: LUNG: PAM_dist: 19: indel length: 0: CRISPR
gRNA ID: GF-CCELg12-83: [crRNA sequence]: crRNA sequence:

TABLE 6-continued

Illustrative guide RNA sequences for Cas12 comprising poylpeptide

TTTAAGATGTTTCTGGCAGCAAGATCTC (SEQ ID NO: 327): LbgRNA:
AATTCTAATACGACTCACTATAGgtaatttctactaagtgtagat AGATGTTTCTGGCAGCAAGATCTC
(SEQ ID NO: 328): [Target gene information]: Gene ID: 2044: Symbol: EPHA5:
Ensembl_Transcript_ID: ENST00000273854.3: GRCh: 37: Chr: 4: [Target cancer mutation
information]: mut_start: 66217192: mut_end: 66217192: mut_class: Missense_Mutation:
mut_type: SNP: ref_seq: A: mut_seq: T: mut_aa: p.I808N: mutation info source: CCLE:
ref_target(-10 +10): GTTACTGTTGATTAAGATGTT (SEQ ID NO: 325): mut_target(-10 +10):
GTTACTGTTGTTTAAGATGTT (SEQ ID NO: 326): [Model Cell line information]: cell:
NCIH1573: cancer_type: LUNG: PAM_dist: -3: indel length: 0: CRISPR gRNA ID: GF-
CCELg12-84: [crRNA sequence]: crRNA sequence: TTTCATAACACCGTCACCAAGATCAAGT
(SEQ ID NO: 329): LbgRNA: AATTCTAATACGACTCACTATAGgtaatttctactaagtgtagat
ATAACACCGTCACCAAGATCAAGT (SEQ ID NO: 330): [Target gene information]: Gene ID:
2044: Symbol: EPHA5: Ensembl_Transcript_ID: ENST00000273854.3: GRCh: 37: Chr: 4:
[Target cancer mutation information]: mut_start: 66467698: mut_end: 66467698: mut_class:
Missense_Mutation: mut_type: SNP: ref_seq: G: mut_seq: C: mut_aa: p.R191G: mutation info
source: CCLE: ref_target(-10 +10): TTCATAACACGGTCACCAAGA (SEQ ID NO: 331):
mut_target(-10 +10): TTCATAACACCGTCACCAAGA (SEQ ID NO: 332): [Model Cell line
information]: cell: NCIH2126: cancer_type: LUNG: PAM_dist: 8: indel length: 0: CRISPR
gRNA ID: GF-CCELg12-85: [crRNA sequence]: crRNA sequence:
TTTACAGAACTTGATCTTGGTGACGGTG (SEQ ID NO: 333): LbgRNA:
AATTCTAATACGACTCACTATAGgtaatttctactaagtgtagat CAGAACTTGATCTTGGTGACGGTG
(SEQ ID NO: 334): [Target gene information]: Gene ID: 2044: Symbol: EPHA5:
Ensembl_Transcript_ID: ENST00000273854.3: GRCh: 37: Chr: 4: [Target cancer mutation
information]: mut_start: 66467698: mut_end: 66467698: mut_class: Missense_Mutation:
mut_type: SNP: ref_seq: G: mut_seq: C: mut_aa: p.R191G: mutation info source: CCLE:
ref_target(-10 +10): TTCATAACACGGTCACCAAGA (SEQ ID NO: 331): mut_target(-10 +10):
TTCATAACACCGTCACCAAGA (SEQ ID NO: 332): [Model Cell line information]: cell:
NCIH2126: cancer_type: LUNG: PAM_dist: 21: indel length: 0: CRISPR gRNA ID: GF-
CCELg12-86: [crRNA sequence]: crRNA sequence: TTTTTTTTTCTGTGTAACCAACTTTCAG
(SEQ ID NO: 335): LbgRNA: AATTCTAATACGACTCACTATAGgtaatttctactaagtgtagat
TTTTTCTGTGTAACCAACTTTCAG (SEQ ID NO: 336): [Target gene information]: Gene ID:
2045: Symbol: EPHA7: Ensembl_Transcript_ID: ENST00000369303.4: GRCh: 37: Chr: 6:
[Target cancer mutation information]: mut_start: 93967904: mut_end: 93967904: mut_class:
Missense_Mutation: mut_type: SNP: ref_seq: G: mut_seq: T: mut_aa: p.Q675K: mutation info
source: CCLE: ref_target(-10 +10): TCTCTCCTTTGTTTTTCTGTG (SEQ ID NO: 337):
mut_target(-10 +10): TCTCTCCTTTTTTTTTCTGTG (SEQ ID NO: 338): [Model Cell line
information]: cell: CFPAC1: cancer_type: PANCREAS: PAM_dist: 0: indel length: 0: CRISPR
gRNA ID: GF-CCELg12-87: [crRNA sequence]: crRNA sequence:
TTTTTTTCTGTGTAACCAACTTTCAGG (SEQ ID NO: 339): LbgRNA:
AATTCTAATACGACTCACTATAGgtaatttctactaagtgtagat TTTTCTGTGTAACCAACTTTCAGG
(SEQ ID NO: 340): [Target gene information]: Gene ID: 2045: Symbol: EPHA7:
Ensembl_Transcript_ID: ENST00000369303.4: GRCh: 37: Chr: 6: [Target cancer mutation
information]: mut_start: 93967904: mut_end: 93967904: mut_class: Missense_Mutation:
mut_type: SNP: ref_seq: G: mut_seq: T: mut_aa: p.Q675K: mutation info source: CCLE:
ref_target(-10 +10): TCTCTCCTTTGTTTTTCTGTG (SEQ ID NO: 337): mut_target(-10 +10):
TCTCTCCTTTTTTTTTCTGTG (SEQ ID NO: 338): [Model Cell line information]: cell: CFPAC1:
cancer_type: PANCREAS: PAM_dist: -1: indel length: 0: CRISPR gRNA ID: GF-CCELg12-88:
[crRNA sequence]: crRNA sequence: TTTTTTTCTGTGTAACCAACTTTCAGGG (SEQ ID NO:
341): LbgRNA: AATTCTAATACGACTCACTATAGgtaatttctactaagtgtagat
TTTCTGTGTAACCAACTTTCAGGG (SEQ ID NO: 342): [Target gene information]: Gene ID:
2045: Symbol: EPHA7: Ensembl_Transcript_ID: ENST00000369303.4: GRCh: 37: Chr: 6:
[Target cancer mutation information]: mut_start: 93967904: mut_end: 93967904: mut_class:
Missense_Mutation: mut_type: SNP: ref_seq: G: mut_seq: T: mut_aa: p.Q675K: mutation info
source: CCLE: ref_target(-10 +10): TCTCTCCTTTGTTTTTCTGTG (SEQ ID NO: 337):
mut_target(-10 +10): TCTCTCCTTTTTTTTTCTGTG (SEQ ID NO: 338): [Model Cell line
information]: cell: CFPAC1: cancer_type: PANCREAS: PAM_dist: -2: indel length: 0: CRISPR
gRNA ID: GF-CCELg12-89: [crRNA sequence]: crRNA sequence:
TTTTTTCTGTGTAACCAACTTTCAGGGT (SEQ ID NO: 343): LbgRNA:
AATTCTAATACGACTCACTATAGgtaatttctactaagtgtagat TTCTGTGTAACCAACTTTCAGGGT
(SEQ ID NO: 344): [Target gene information]: Gene ID: 2045: Symbol: EPHA7:
Ensembl_Transcript_ID: ENST00000369303.4: GRCh: 37: Chr: 6: [Target cancer mutation
information]: mut_start: 93967904: mut_end: 93967904: mut_class: Missense_Mutation:
mut_type: SNP: ref_seq: G: mut_seq: T: mut_aa: p.Q675K: mutation info source: CCLE:
ref_target(-10 +10): TCTCTCCTTTGTTTTTCTGTG (SEQ ID NO: 337): mut_target(-10 +10):
TCTCTCCTTTTTTTTTCTGTG (SEQ ID NO: 338): [Model Cell line information]: cell: CFPAC1:
cancer_type: PANCREAS: PAM_dist: -3: indel length: 0: CRISPR gRNA ID: GF-CCELg12-90:
[crRNA sequence]: crRNA sequence: TTTCATCTGCAGCAATGGTGTTTATTTT (SEQ ID NO:
345): LbgRNA: AATTCTAATACGACTCACTATAGgtaatttctactaagtgtagat
ATCTGCAGCAATGGTGTTTATTTT (SEQ ID NO: 346): [Target gene information]: Gene ID:
2045: Symbol: EPHA7: Ensembl_Transcript_ID: ENST00000369303.4: GRCh: 37: Chr: 6:
[Target cancer mutation information]: mut_start: 94120612: mut_end: 94120612: mut_class:
Missense_Mutation: mut_type: SNP: ref_seq: C: mut_seq: T: mut_aa: p.D147N: mutation info
source: CCLE: ref_target(-10 +10): GCAATGGTGTCTATTTTACA (SEQ ID NO: 347):
mut_target(-10 +10): GCAATGGTGTTTATTTTACA (SEQ ID NO: 348): [Model Cell line
information]: cell: NCIH1563: cancer_type: LUNG: PAM_dist: 18: indel length: 0: CRISPR

TABLE 6-continued

Illustrative guide RNA sequences for Cas12 comprising poylpeptide gRNA ID: GF-CCELg12-91: [crRNA sequence]: crRNA sequence:
T<u>T</u>TATTTTTACATAGAGGTTTTCTCTTA (SEQ ID NO: 349): LbgRNA:
AATTCTAATACGACTCACTATAGgtaatttctactaagtgtagat TTTTTACATAGAGGTTTTCTCTTA
(SEQ ID NO: 350): [Target gene information]: Gene ID: 2045: Symbol: EPHA7:
Ensembl_Transcript_ID: ENST00000369303.4: GRCh: 37: Chr: 6: [Target cancer mutation
information]: mut_start: 94120612: mut_end: 94120612: mut_class: Missense_Mutation:
mut_type: SNP: ref_seq: C: mut_seq: T: mut_aa: p.D147N: mutation info source: CCLE:
ref_target(-10 +10): GCAATGGTGT<u>C</u>TATTTTTACA (SEQ ID NO: 347): mut_target(-10 +10):
GCAATGGTGT<u>T</u>TATTTTTACA (SEQ ID NO: 348): [Model Cell line information]: cell:
NCIH1563: cancer_type: LUNG: PAM_dist: -2: indel length: 0: CRISPR gRNA ID: GF-
CCELg12-92: [crRNA sequence]: crRNA sequence: TTTCTTTTGATGACCAACCA<u>T</u>TGTGATC
(SEQ ID NO: 351): LbgRNA: AATTCTAATACGACTCACTATAGgtaatttctactaagtgtagat
TTTTGATGACCAACCATTGTGATC (SEQ ID NO: 352): [Target gene information]: Gene ID:
2045: Symbol: EPHA7: Ensembl_Transcript_ID: ENST00000369303.4: GRCh: 37: Chr: 6:
[Target cancer mutation information]: mut_start: 93953233: mut_end: 93953233: mut_class:
Missense_Mutation: mut_type: SNP: ref_seq: G: mut_seq: T: mut_aa: p.L970M: mutation info
source: CCLE: ref_target(-10 +10): TGACCAACCA<u>G</u>TGTGATCCCT (SEQ ID NO: 353):
mut_target(-10 +10): TGACCAACCA<u>TT</u>GTGATCCCT (SEQ ID NO: 354): [Model Cell line
information]: cell: NCIH1573: cancer_type: LUNG: PAM_dist: 17: indel length: 0: CRISPR
gRNA ID: GF-CCELg12-93: [crRNA sequence]: crRNA sequence:
TTTGATGACCAACCA<u>T</u>TGTGATCCCTAA (SEQ ID NO: 355): LbgRNA:
AATTCTAATACGACTCACTATAGgtaatttctactaagtgtagat ATGACCAACCATTGTGATCCCTAA
(SEQ ID NO: 356): [Target gene information]: Gene ID: 2045: Symbol: EPHA7:
Ensembl_Transcript_ID: ENST00000369303.4: GRCh: 37: Chr: 6: [Target cancer mutation
information]: mut_start: 93953233: mut_end: 93953233: mut_class: Missense_Mutation:
mut_type: SNP: ref_seq: G: mut_seq: T: mut_aa: p.L970M: mutation info source: CCLE:
ref_target(-10 +10): TGACCAACCA<u>G</u>TGTGATCCCT (SEQ ID NO: 353): mut_target(-10 +10):
TGACCAACCA<u>TT</u>GTGATCCCT (SEQ ID NO: 354): [Model Cell line information]: cell:
NCIH1573: cancer_type: LUNG: PAM_dist: 12: indel length: 0: CRISPR gRNA ID: GF-
CCELg12-94: [crRNA sequence]: crRNA sequence: TTTTCTTTTGATGACCAACCA<u>T</u>TGTGAT
(SEQ ID NO: 357): LbgRNA: AATTCTAATACGACTCACTATAGgtaatttctactaagtgtagat
CTTTTGATGACCAACCATTGTGAT (SEQ ID NO: 358): [Target gene information]: Gene ID:
2045: Symbol: EPHA7: Ensembl_Transcript_ID: ENST00000369303.4: GRCh: 37: Chr: 6:
[Target cancer mutation information]: mut_start: 93953233: mut_end: 93953233: mut_class:
Missense_Mutation: mut_type: SNP: ref_seq: G: mut_seq: T: mut_aa: p.L970M: mutation info
source: CCLE: ref_target(-10 +10): TGACCAACCA<u>G</u>TGTGATCCCT (SEQ ID NO: 353):
mut_target(-10 +10): TGACCAACCA<u>TT</u>GTGATCCCT (SEQ ID NO: 354): [Model Cell line
information]: cell: NCIH1573: cancer_type: LUNG: PAM_dist: 18: indel length: 0:: CRISPR
gRNA ID: GF-CCELg12-95: [crRNA sequence]: crRNA sequence:
TTTTGATGACCAACCA<u>T</u>TGTGATCCCTA (SEQ ID NO: 359): LbgRNA:
AATTCTAATACGACTCACTATAGgtaatttctactaagtgtagat GATGACCAACCATTGTGATCCCTA
(SEQ ID NO: 360): [Target gene information]: Gene ID: 2045: Symbol: EPHA7:
Ensembl_Transcript_ID: ENST00000369303.4: GRCh: 37: Chr: 6: [Target cancer mutation
information]: mut_start: 93953233: mut_end: 93953233: mut_class: Missense_Mutation:
mut_type: SNP: ref_seq: G: mut_seq: T: mut_aa: p.L970M: mutation info source: CCLE:
ref_target(-10 +10): TGACCAACCA<u>G</u>TGTGATCCCT (SEQ ID NO: 353): mut_target(-10 +10):
TGACCAACCA<u>TT</u>GTGATCCCT (SEQ ID NO: 354): [Model Cell line information]: cell:
NCIH1573: cancer_type: LUNG: PAM_dist: 13: indel length: 0: CRISPR gRNA ID: GF-
CCELg12-96: [crRNA sequence]: crRNA sequence: TTTAGGGATCACA<u>A</u>TGGTTGGTCATCAA
(SEQ ID NO: 361): LbgRNA: AATTCTAATACGACTCACTATAGgtaatttctactaagtgtagat
GGGATCACAATGGTTGGTCATCAA (SEQ ID NO: 362): [Target gene information]: Gene ID:
2045: Symbol: EPHA7: Ensembl_Transcript_ID: ENST00000369303.4: GRCh: 37: Chr: 6:
[Target cancer mutation information]: mut_start: 93953233: mut_end: 93953233: mut_class:
Missense_Mutation: mut_type: SNP: ref_seq: G: mut_seq: T: mut_aa: p.L970M: mutation info
source: CCLE: ref_target(-10 +10): TGACCAACCA<u>G</u>TGTGATCCCT (SEQ ID NO: 353):
mut_target(-10 +10): TGACCAACCA<u>TT</u>GTGATCCCT (SEQ ID NO: 354): [Model Cell line
information]: cell: NCIH1573: cancer_type: LUNG: PAM_dist: 10: indel length: 0: CRISPR
gRNA ID: GF-CCELg12-97: [crRNA sequence]: crRNA sequence:
T<u>T</u>TGGGAGCAGGGCGAATGTGTTCCCTG (SEQ ID NO: 363): LbgRNA:
AATTCTAATACGACTCACTATAGgtaatttctactaagtgtagat GGAGCAGGGCGAATGTGTTCCCTG
(SEQ ID NO: 364): [Target gene information]: Gene ID: 2045: Symbol: EPHA7:
Ensembl_Transcript_ID: ENST00000369303.4: GRCh: 37: Chr: 6: [Target cancer mutation
information]: mut_start: 94066641: mut_end: 94066641: mut_class: Missense_Mutation:
mut_type: SNP: ref_seq: C: mut_seq: A: mut_aa: p.S373I: mutation info source: CCLE:
ref_target(-10 +10): CTGCTCCCA<u>C</u>TGCACCGCTT (SEQ ID NO: 365): mut_target(-10 +10):
CTGCTCCCA<u>A</u>TGCACCGCTT (SEQ ID NO: 366): [Model Cell line information]: cell:
NCIH1573: cancer_type: LUNG: PAM_dist: -3: indel length: 0: CRISPR gRNA ID: GF-
CCELg12-98: [crRNA sequence]: crRNA sequence: TTTGTTGTGCTTTAGAATCCAGCAGTA<u>A</u>
(SEQ ID NO: 367): LbgRNA: AATTCTAATACGACTCACTATAGgtaatttctactaagtgtagat
TTGTGCTTTAGAATCCAGCAGTAA (SEQ ID NO: 368): [Target gene information]: Gene ID:
2045: Symbol: EPHA7: Ensembl_Transcript_ID: ENST00000369303.4: GRCh: 37: Chr: 6:
[Target cancer mutation information]: mut_start: 94124483: mut_end: 94124483: mut_class: Silent:
mut_type: SNP: ref_seq: G: mut_seq: A: mut_aa: p.L34L: mutation info source: CCLE:
ref_target(-10 +10): TCCAGCA<u>G</u>TAGTACTGAAAAA (SEQ ID NO: 369): mut_target(-10 +10):
TCCAGCAGTA<u>A</u>TACTGAAAAA (SEQ ID NO: 370): [Model Cell line information]: cell:

TABLE 6-continued

Illustrative guide RNA sequences for Cas12 comprising poylpeptide

NCIH1573: cancer_type: LUNG: PAM_dist: 24: indel length: 0: CRISPR gRNA ID: GF-
CCELg12-99: [crRNA sequence]: crRNA sequence: TTTAGAATCCAGCAGTAATACTGAAAAA
(SEQ ID NO: 371): LbgRNA: AATTCTAATACGACTCACTATAGgtaatttctactaagtgtagat
GAATCCAGCAGTAATACTGAAAAA (SEQ ID NO: 372): [Target gene information]: Gene ID:
2045: Symbol: EPHA7: Ensembl_Transcript_ID: ENST00000369303.4: GRCh: 37: Chr: 6:
[Target cancer mutation information]: mut_start: 94124483: mut_end: 94124483: mut_class: Silent:
mut_type: SNP: ref_seq: G: mut_seq: A: mut_aa: p.L34L: mutation info source: CCLE:
ref_target(-10 +10): TCCAGCAGTAGTACTGAAAAA (SEQ ID NO: 369): mut_target(-10 +10):
TCCAGCAGTAATACTGAAAAA (SEQ ID NO: 370): [Model Cell line information]: cell:
NCIH1573: cancer_type: LUNG: PAM_dist: 14: indel length: 0: CRISPR gRNA ID: GF-
CCELg12-100: [crRNA sequence]: crRNA sequence: TTTCTTTTTCAGTATTACTGCTGGATTC
(SEQ ID NO: 373): LbgRNA: AATTCTAATACGACTCACTATAGgtaatttctactaagtgtagat
TTTTTCAGTATTACTGCTGGATTC (SEQ ID NO: 374): [Target gene information]: Gene ID:
2045: Symbol: EPHA7: Ensembl_Transcript_ID: ENST00000369303.4: GRCh: 37: Chr: 6:
[Target cancer mutation information]: mut_start: 94124483: mut_end: 94124483: mut_class: Silent:
mut_type: SNP: ref_seq: G: mut_seq: A: mut_aa: p.L34L: mutation info source: CCLE:
ref_target(-10 +10): TCCAGCAGTAGTACTGAAAAA (SEQ ID NO: 369): mut_target(-10 +10):
TCCAGCAGTAATACTGAAAAA (SEQ ID NO: 370): [Model Cell line information]: cell:
NCIH1573: cancer_type: LUNG: PAM_dist: 11: indel length: 0: CRISPR gRNA ID: GF-
CCELg12-101: [crRNA sequence]: crRNA sequence: TTTCAGTATTACTGCTGGATTCTAAAGC
(SEQ ID NO: 375): LbgRNA: AATTCTAATACGACTCACTATAGgtaatttctactaagtgtagat
AGTATTACTGCTGGATTCTAAAGC (SEQ ID NO: 376): [Target gene information]: Gene ID:
2045: Symbol: EPHA7: Ensembl_Transcript_ID: ENST00000369303.4: GRCh: 37: Chr: 6:
[Target cancer mutation information]: mut_start: 94124483: mut_end: 94124483: mut_class: Silent:
mut_type: SNP: ref_seq: G: mut_seq: A: mut_aa: p.L34L: mutation info source: CCLE:
ref_target(-10 +10): TCCAGCAGTAGTACTGAAAAA (SEQ ID NO: 369): mut_target(-10 +10):
TCCAGCAGTAATACTGAAAAA (SEQ ID NO: 370): [Model Cell line information]: cell:
NCIH1573: cancer_type: LUNG: PAM_dist: 5: indel length: 0: CRISPR gRNA ID: GF-
CCELg12-102: [crRNA sequence]: crRNA sequence: TTTTTCAGTATTACTGCTGGATTCTAAA
(SEQ ID NO: 377): LbgRNA: AATTCTAATACGACTCACTATAGgtaatttctactaagtgtagat
TCAGTATTACTGCTGGATTCTAAA (SEQ ID NO: 378): [Target gene information]: Gene ID:
2045: Symbol: EPHA7: Ensembl_Transcript_ID: ENST00000369303.4: GRCh: 37: Chr: 6:
[Target cancer mutation information]: mut_start: 94124483: mut_end: 94124483: mut_class: Silent:
mut_type: SNP: ref_seq: G: mut_seq: A: mut_aa: p.L34L: mutation info source: CCLE:
ref_target(-10 +10): TCCAGCAGTAGTACTGAAAAA (SEQ ID NO: 369): mut_target(-10 +10):
TCCAGCAGTAATACTGAAAAA (SEQ ID NO: 370): [Model Cell line information]: cell:
NCIH1573: cancer_type: LUNG: PAM_dist: 7: indel length: 0: CRISPR gRNA ID: GF-
CCELg12-103: [crRNA sequence]: crRNA sequence: TTTTCAGTATTACTGCTGGATTCTAAAG
(SEQ ID NO: 379): LbgRNA: AATTCTAATACGACTCACTATAGgtaatttctactaagtgtagat
CAGTATTACTGCTGGATTCTAAAG (SEQ ID NO: 380): [Target gene information]: Gene ID:
2045: Symbol: EPHA7: Ensembl_Transcript_ID: ENST00000369303.4: GRCh: 37: Chr: 6:
[Target cancer mutation information]: mut_start: 94124483: mut_end: 94124483: mut_class: Silent:
mut_type: SNP: ref_seq: G: mut_seq: A: mut_aa: p.L34L: mutation info source: CCLE:
ref_target(-10 +10): TCCAGCAGTAGTACTGAAAAA (SEQ ID NO: 369): mut_target(-10 +10):
TCCAGCAGTAATACTGAAAAA (SEQ ID NO: 370): [Model Cell line information]: cell:
NCIH1573: cancer_type: LUNG: PAM_dist: 6: indel length: 0: CRISPR gRNA ID: GF-
CCELg12-104: [crRNA sequence]: crRNA sequence: TTTCAGACTATTTGGTTTCGAATCATTT
(SEQ ID NO: 381): LbgRNA: AATTCTAATACGACTCACTATAGgtaatttctactaagtgtagat
AGACTATTTGGTTTCGAATCATTT (SEQ ID NO: 382): [Target gene information]: Gene ID:
2045: Symbol: EPHA7: Ensembl_Transcript_ID: ENST00000369303.4: GRCh: 37: Chr: 6:
[Target cancer mutation information]: mut_start: 93956546: mut_end: 93956546: mut_class:
Frame_Shift_Del: mut_type: DEL: ref_seq: G: mut_seq: -: mut_aa: p.P897fs: mutation info
source: CCLE: ref_target(-10 +10): CAGACTATTTGGGTTTCGAAT (SEQ ID NO: 383):
mut_target(-10 +10): CAGACTATTT-GGTTTCGAAT (SEQ ID NO: 384): [Model Cell line
information]: cell: NCIH460: cancer_type: LUNG: PAM_dist: 10: indel length: 1: CRISPR
gRNA ID: GF-CCELg12-105: [crRNA sequence]: crRNA sequence:
TTTGGTTTCGAATCATTTTGTCTAGAAT (SEQ ID NO: 385): LbgRNA:
AATTCTAATACGACTCACTATAGgtaatttctactaagtgtagat GTTTCGAATCATTTTGTCTAGAAT
(SEQ ID NO: 386): [Target gene information]: Gene ID: 2045: Symbol: EPHA7:
Ensembl_Transcript_ID: ENST00000369303.4: GRCh: 37: Chr: 6: [Target cancer mutation
information]: mut_start: 93956546: mut_end: 93956546: mut_class: Frame_Shift_Del: mut_type:
DEL: ref_seq: G: mut_seq: -: mut_aa: p.P897fs: mutation info source: CCLE: ref_target(-10
+10): CAGACTATTTGGGTTTCGAAT (SEQ ID NO: 383): mut_target(-10 +10): CAGACTATTT-
GGTTTCGAAT (SEQ ID NO: 384): [Model Cell line information]: cell: NCIH460: cancer_type:
LUNG: PAM_dist: 0: indel length: 1: CRISPR gRNA ID: GF-CCELg12-106: [crRNA sequence]:
crRNA sequence: TTTTCAGACTATTTGGTTTCGAATCATT (SEQ ID NO: 387): LbgRNA:
AATTCTAATACGACTCACTATAGgtaatttctactaagtgtagat CAGACTATTTGGTTTCGAATCATT
(SEQ ID NO: 388): [Target gene information]: Gene ID: 2045: Symbol: EPHA7:
Ensembl_Transcript_ID: ENST00000369303.4: GRCh: 37: Chr: 6: [Target cancer mutation
information]: mut_start: 93956546: mut_end: 93956546: mut_class: Frame_Shift_Del: mut_type:
DEL: ref_seq: G: mut_seq: -: mut_aa: p.P897fs: mutation info source: CCLE: ref_target(-10
+10): CAGACTATTTGGGTTTCGAAT (SEQ ID NO: 383): mut_target(-10 +10): CAGACTATTT-
GGTTTCGAAT (SEQ ID NO: 384): [Model Cell line information]: cell: NCIH460: cancer_type:
LUNG: PAM_dist: 11: indel length: 1: CRISPR gRNA ID: GF-CCELg12-107: [crRNA sequence]:
crRNA sequence: TTTGCAGCCTGTAAGGGAACAGGCTCTG (SEQ ID NO: 389): LbgRNA:
AATTCTAATACGACTCACTATAGgtaatttctactaagtgtagat CAGCCTGTAAGGGAACAGGCTCTG
(SEQ ID NO: 390): [Target gene information]: Gene ID: 2065: Symbol: ERBB3:
Ensembl_Transcript_ID: ENST00000267101.3: GRCh: 37: Chr: 12: [Target cancer mutation TABLE 6-continued Illustrative guide RNA sequences for Cas12 comprising poylpeptide information]: mut_start: 56482537: mut_end: 56482537: mut_class: Missense_Mutation:
mut_type: SNP: ref_seq: G: mut_seq: A: mut_aa: p.E332K: mutation info source: CCLE:
ref_target(-10 +10): TGCAGCCTGTGAGGGAACAGG (SEQ ID NO: 391): mut_target(-10 +10):
TGCAGCCTGTAAGGGAACAGG (SEQ ID NO: 392): [Model Cell line information]: cell:
NCIH1573: cancer_type: LUNG: PAM_dist: 9: indel length: 0: CRISPR gRNA ID: GF-
CCELg12-108: [crRNA sequence]: crRNA sequence:
TTTCCAGTTGGAACCCAATCCCCACACC (SEQ ID NO: 393): LbgRNA:
AATTCTAATACGACTCACTATAGgtaatttctactaagtgtagat CAGTTGGAACCCAATCCCCACACC
(SEQ ID NO: 394): [Target gene information]: Gene ID: 2065: Symbol: ERBB3:
Ensembl_Transcript_ID: ENST00000267101.3: GRCh: 37: Chr: 12: [Target cancer mutation
information]: mut_start: 56481886: mut_end: 56481886: mut_class: Silent: mut_type: SNP:
ref_seq: C: mut_seq: T: mut_aa: p.L272L: mutation info source: CCLE: ref_target(-10 +10):
AACTTTCCAGCTGGAACCCAA (SEQ ID NO: 395): mut_target(-10 +10):
AACTTTCCAGTTGGAACCCAA (SEQ ID NO: 396): [Model Cell line information]: cell:
NCIH2126: cancer_type: LUNG: PAM_dist: 4: indel length: 0: CRISPR gRNA ID: GF-
CCELg12-109: [crRNA sequence]: crRNA sequence:
TTTGGGATTGGACCGGAATAAGTTAATA (SEQ ID NO: 397): LbgRNA:
AATTCTAATACGACTCACTATAGgtaatttctactaagtgtagat GGATTGGACCGGAATAAGTTAATA
(SEQ ID NO: 398): [Target gene information]: Gene ID: 2073: Symbol: ERCC5:
Ensembl_Transcript_ID: ENST00000355739.4: GRCh: 37: Chr: 13: [Target cancer mutation
information]: mut_start: 103520461: mut_end: 103520461: mut_class: Splice_Site: mut_type:
SNP: ref_seq: A: mut_seq: G: mut_aa: FALSE: mutation info source: CCLE: ref_target(-10
+10): GTTACTCTTTAGGATTGGACC (SEQ ID NO: 399): mut_target(-10 +10):
GTTACTCTTTGGGATTGGACC (SEQ ID NO: 400): [Model Cell line information]: cell:
NCIH1573: cancer_type: LUNG: PAM_dist: 0: indel length: 0: CRISPR gRNA ID: GF-
CCELg12-110: [crRNA sequence]: crRNA sequence: TTTATTAACTTATTCCGGTCCAATCCCA
(SEQ ID NO: 401): LbgRNA: AATTCTAATACGACTCACTATAGgtaatttctactaagtgtagat
TTAACTTATTCCGGTCCAATCCCA (SEQ ID NO: 402): [Target gene information]: Gene ID:
2073: Symbol: ERCC5: Ensembl_Transcript_ID: ENST00000355739.4: GRCh: 37: Chr: 13:
[Target cancer mutation information]: mut_start: 103520461: mut_end: 103520461: mut_class:
Splice_Site: mut_type: SNP: ref_seq: A: mut_seq: G: mut_aa: FALSE: mutation info source:
CCLE: ref_target(-10 +10): GTTACTCTTTAGGATTGGACC (SEQ ID NO: 399): mut_target(-10
+10): GTTACTCTTTGGGATTGGACC (SEQ ID NO: 400): [Model Cell line information]: cell:
NCIH1573: cancer_type: LUNG: PAM_dist: 23: indel length: 0: CRISPR gRNA ID: GF-
CCELg12-111: [crRNA sequence]: crRNA sequence: TTTCCCCCCACTCAATAGCGTGTCTCCG
(SEQ ID NO: 403): LbgRNA: AATTCTAATACGACTCACTATAGgtaatttctactaagtgtagat
CCCCCACTCAATAGCGTGTCTCCG (SEQ ID NO: 404): [Target gene information]: Gene ID:
2099: Symbol: ESR1: Ensembl_Transcript_ID: ENST00000206249.3: GRCh: 37: Chr: 6: [Target
cancer mutation information]: mut_start: 152129350: mut_end: 152129350: mut_class: Silent:
mut_type: SNP: ref_seq: C: mut_seq: T: mut_aa: p.N101N: mutation info source: CCLE:
ref_target(-10 +10): CCCCACTCAACAGCGTGTCTC (SEQ ID NO: 405): mut_target(-10 +10):
CCCCACTCAATAGCGTGTCTC (SEQ ID NO: 406): [Model Cell line information]: cell:
NCIH1650: cancer_type: LUNG: PAM_dist: 12: indel length: 0: CRISPR gRNA ID: GF-
CCELg12-112: [crRNA sequence]: crRNA sequence:
TTTGTACCAGACTATCAGGCTGAAGTA   (SEQ ID NO: 407): LbgRNA:
AATTCTAATACGACTCACTATAGgtaatttctactaagtgtagat TACCAGACTATCAGGCTGAAAGTA
(SEQ ID NO: 408): [Target gene information]: Gene ID: 2115: Symbol: ETV1:
Ensembl_Transcript_ID: ENST00000430479.1: GRCh: 37: Chr: 7: [Target cancer mutation
information]: mut_start: 14017052: mut_end: 14017052: mut_class: Splice_Site: mut_type: SNP:
ref_seq: A: mut_seq: T: mut_aa: p.L79M: mutation info source: CCLE: ref_target(-10 +10):
CTATACTTACAACTTTCAGCC (SEQ ID NO: 409): mut_target(-10 +10):
CTATACTTACTACTTTCAGCC (SEQ ID NO: 410): [Model Cell line information]: cell:
NCIH2126: cancer_type: LUNG: PAM_dist: 24: indel length: 0: CRISPR gRNA ID: GF-
CCELg12-113: [crRNA sequence]: crRNA sequence: TTTCAAGGCTTCATACATCTTCCCTAGG
(SEQ ID NO: 411): LbgRNA: AATTCTAATACGACTCACTATAGgtaatttctactaagtgtagat
AAGGCTTCATACATCTTCCCTAGG (SEQ ID NO: 412): [Target gene information]: Gene ID:
2176: Symbol: FANCC: Ensembl_Transcript_ID: ENST00000289081.3: GRCh: 37: Chr: 9:
[Target cancer mutation information]: mut_start: 98011438: mut_end: 98011438: mut_class:
Missense_Mutation: mut_type: SNP: ref_seq: T: mut_seq: C: mut_aa: p.R46G: mutation info
source: CCLE: ref_target(-10 +10): TACATCTTCCTTAGGAACTCC (SEQ ID NO: 413):
mut_target(-10 +10): TACATCTTCCCTAGGAACTCC (SEQ ID NO: 414): [Model Cell line
information]: cell: NCIH661: cancer_type: LUNG: PAM_dist: 20: indel length: 0: CRISPR
gRNA ID: GF-CCELg12-114: [crRNA sequence]: crRNA sequence:
TTTCTGCATTTGCTTCAATATCACGACT (SEQ ID NO: 415): LbgRNA:
AATTCTAATACGACTCACTATAGgtaatttctactaagtgtagat TGCATTTGCTTCAATATCACGACT
(SEQ ID NO: 416): [Target gene information]: Gene ID: 2195: Symbol: FAT1:
Ensembl_Transcript_ID: ENST00000441802.2: GRCh: 37: Chr: 4: [Target cancer mutation
information]: mut_start: 187532622: mut_end: 187532622: mut_class: Silent: mut_type: SNP:
ref_seq: C: mut_seq: A: mut_aa: p.R3257R: mutation info source: CCLE: ref_target(-10 +10):
CTTCAATATCCCGACTTGCTG (SEQ ID NO: 417): mut_target(-10 +10):
CTTCAATATCACGACTTGCTG (SEQ ID NO: 418): [Model Cell line information]: cell:
NCIH661: cancer_type: LUNG: PAM_dist: 19: indel length: 0: CRISPR gRNA ID: GF-
CCELg12-115: [crRNA sequence]: crRNA sequence: TTTGCTTCAATATCACGACTTGCTGCAT
(SEQ ID NO: 419): LbgRNA: AATTCTAATACGACTCACTATAGgtaatttctactaagtgtagat
CTTCAATATCACGACTTGCTGCAT (SEQ ID NO: 420): [Target gene information]: Gene ID:
2195: Symbol: FAT1: Ensembl_Transcript_ID: ENST00000441802.2: GRCh: 37: Chr: 4:
[Target cancer mutation information]: mut_start: 187532622: mut_end: 187532622: mut_class:
Silent: mut_type: SNP: ref_seq: C: mut_seq: A: mut_aa: p.R3257R: mutation info source: CCLE:

TABLE 6-continued

Illustrative guide RNA sequences for Cas12 comprising poylpeptide ref_target(-10 +10): CTTCAATATCCCGACTTGCTG (SEQ ID NO: 417): mut_target(-10 +10):
CTTCAATATCACGACTTGCTG (SEQ ID NO: 418): [Model Cell line information]: cell:
NCIH661: cancer_type: LUNG: PAM_dist: 11: indel length: 0: CRISPR gRNA ID: GF-
CCELg12-116: [crRNA sequence]: crRNA sequence: TTTGTGTTTGAGGCTCTGATCCGTCACA
(SEQ ID NO: 421): LbgRNA: AATTCTAATACGACTCACTATAGgtaatttctactaagtgtagat
TGTTTGAGGCTCTGATCCGTCACA (SEQ ID NO: 422): [Target gene information]: Gene ID:
55294: Symbol: FBXW7: Ensembl_Transcript_ID: ENST00000281708.4: GRCh: 37: Chr: 4:
[Target cancer mutation information]: mut_start: 153244138: mut_end: 153244138: mut_class:
Nonsense_Mutation: mut_type: SNP: ref_seq: C: mut_seq: T: mut_aa: p.W673*: mutation info
source: CCLE: ref_target(-10 +10): CTCTGATCCGCCACACAACTC (SEQ ID NO: 423):
mut_target(-10 +10): CTCTGATCCGTCACACAACTC (SEQ ID NO: 424): [Model Cell line
information]: cell: NCIH1573: cancer_type: LUNG: PAM_dist: 20: indel length: 0: CRISPR
gRNA ID: GF-CCELg12-117: [crRNA sequence]: crRNA sequence:
TTTGAGGCTCTGATCCGTCACACAACTC (SEQ ID NO: 425): LbgRNA:
AATTCTAATACGACTCACTATAGgtaatttctactaagtgtagat AGGCTCTGATCCGTCACACAACTC
(SEQ ID NO: 426): [Target gene information]: Gene ID: 55294: Symbol: FBXW7:
Ensembl_Transcript_ID: ENST00000281708.4: GRCh: 37: Chr: 4: [Target cancer mutation
information]: mut_start: 153244138: mut_end: 153244138: mut_class: Nonsense_Mutation:
mut_type: SNP: ref_seq: C: mut_seq: T: mut_aa: p.W673*: mutation info source: CCLE:
ref_target(-10 +10): CTCTGATCCGCCACACAACTC (SEQ ID NO: 423): mut_target(-10 +10):
CTCTGATCCGTCACACAACTC (SEQ ID NO: 424): [Model Cell line information]: cell:
NCIH1573: cancer_type: LUNG: PAM_dist: 14: indel length: 0: CRISPR gRNA ID: GF-
CCELg12-118: [crRNA sequence]: crRNA sequence: TTTGTGCCTTGTCATACACTGAAGAAA
(SEQ ID NO: 427): LbgRNA: AATTCTAATACGACTCACTATAGgtaatttctactaagtgtagat
CTGCCTTGTCATACACTGAAGAAA (SEQ ID NO: 428): [Target gene information]: Gene ID:
2271: Symbol: FH: Ensembl_Transcript_ID: ENST00000366560.3: GRCh: 37: Chr: 1: [Target
cancer mutation information]: mut_start: 241661270: mut_end: 241661270: mut_class: Splice_Site:
mut_type: SNP: ref_seq: C: mut_seq: A: mut_aa: p.G464V: mutation info source: CCLE:
ref_target(-10 +10): CTTGTCATACCCTGAAGAAAA (SEQ ID NO: 429): mut_target(-10 +10):
CTTGTCATACACTGAAGAAAA (SEQ ID NO: 430): [Model Cell line information]: cell: A549:
cancer_type: LUNG: PAM_dist: 15: indel length: 0: CRISPR gRNA ID: GF-CCELg12-119:
[crRNA sequence]: crRNA sequence: TTTCTTCAGTGTATGACAAGGCAGCAAA (SEQ ID NO:
431): LbgRNA: AATTCTAATACGACTCACTATAGgtaatttctactaagtgtagat
TTCAGTGTATGACAAGGCAGCAAA (SEQ ID NO: 432): [Target gene information]: Gene ID:
2271: Symbol: FH: Ensembl_Transcript_ID: ENST00000366560.3: GRCh: 37: Chr: 1: [Target
cancer mutation information]: mut_start: 241661270: mut_end: 241661270: mut_class: Splice_Site:
mut_type: SNP: ref_seq: C: mut_seq: A: mut_aa: p.G464V: mutation info source: CCLE:
ref_target(-10 +10): CTTGTCATACCCTGAAGAAAA (SEQ ID NO: 429): mut_target(-10 +10):
CTTGTCATACACTGAAGAAAA (SEQ ID NO: 430): [Model Cell line information]: cell: A549:
cancer_type: LUNG: PAM_dist: 6: indel length: 0: CRISPR gRNA ID: GF-CCELg12-120:
[crRNA sequence]: crRNA sequence: TTTATTTTTCTTCAGTGTATGACAAGG (SEQ ID NO:
433): LbgRNA: AATTCTAATACGACTCACTATAGgtaatttctactaagtgtagat
TTTTTTCTTCAGTGTATGACAAGG (SEQ ID NO: 434): [Target gene information]: Gene ID:
2271: Symbol: FH: Ensembl_Transcript_ID: ENST00000366560.3: GRCh: 37: Chr: 1: [Target
cancer mutation information]: mut_start: 241661270: mut_end: 241661270: mut_class: Splice_Site:
mut_type: SNP: ref_seq: C: mut_seq: A: mut_aa: p.G464V: mutation info source: CCLE:
ref_target(-10 +10): CTTGTCATACCCTGAAGAAAA (SEQ ID NO: 429): mut_target(-10 +10):
CTTGTCATACACTGAAGAAAA (SEQ ID NO: 430): [Model Cell line information]: cell: A549:
cancer_type: LUNG: PAM_dist: 13: indel length: 0:: CRISPR gRNA ID: GF-CCELg12-121:
[crRNA sequence]: crRNA sequence: TTTTTATTTTTCTTCAGTGTATGACAA (SEQ ID NO:
435): LbgRNA: AATTCTAATACGACTCACTATAGgtaatttctactaagtgtagat
TATTTTTCTTCAGTGTATGACAA (SEQ ID NO: 436): [Target gene information]: Gene ID:
2271: Symbol: FH: Ensembl_Transcript_ID: ENST00000366560.3: GRCh: 37: Chr: 1: [Target
cancer mutation information]: mut_start: 241661270: mut_end: 241661270: mut_class: Splice_Site:
mut_type: SNP: ref_seq: C: mut_seq: A: mut_aa: p.G464V: mutation info source: CCLE:
ref_target(-10 +10): CTTGTCATACCCTGAAGAAAA (SEQ ID NO: 429): mut_target(-10 +10):
CTTGTCATACACTGAAGAAAA (SEQ ID NO: 430): [Model Cell line information]: cell: A549:
cancer_type: LUNG: PAM_dist: 15: indel length: 0: CRISPR gRNA ID: GF-CCELg12-122:
[crRNA sequence]: crRNA sequence: TTTTATTTTTCTTCAGTGTATGACAAG (SEQ ID NO:
437): LbgRNA: AATTCTAATACGACTCACTATAGgtaatttctactaagtgtagat
ATTTTTCTTCAGTGTATGACAAG (SEQ ID NO: 438): [Target gene information]: Gene ID:
2271: Symbol: FH: Ensembl_Transcript_ID: ENST00000366560.3: GRCh: 37: Chr: 1: [Target
cancer mutation information]: mut_start: 241661270: mut_end: 241661270: mut_class: Splice_Site:
mut_type: SNP: ref_seq: C: mut_seq: A: mut_aa: p.G464V: mutation info source: CCLE:
ref_target(-10 +10): CTTGTCATACCCTGAAGAAAA (SEQ ID NO: 429): mut_target(-10 +10):
CTTGTCATACACTGAAGAAAA (SEQ ID NO: 430): [Model Cell line information]: cell: A549:
cancer_type: LUNG: PAM_dist: 14: indel length: 0: CRISPR gRNA ID: GF-CCELg12-123:
[crRNA sequence]: crRNA sequence: TTTTTTCTTCAGTGTATGACAAGGCAGC (SEQ ID NO:
439): LbgRNA: AATTCTAATACGACTCACTATAGgtaatttctactaagtgtagat
TTCTTCAGTGTATGACAAGGCAGC (SEQ ID NO: 440): [Target gene information]: Gene ID:
2271: Symbol: FH: Ensembl_Transcript_ID: ENST00000366560.3: GRCh: 37: Chr: 1: [Target
cancer mutation information]: mut_start: 241661270: mut_end: 241661270: mut_class: Splice_Site:
mut_type: SNP: ref_seq: C: mut_seq: A: mut_aa: p.G464V: mutation info source: CCLE:
ref_target(-10 +10): CTTGTCATACCCTGAAGAAAA (SEQ ID NO: 429): mut_target(-10 +10):
CTTGTCATACACTGAAGAAAA (SEQ ID NO: 430): [Model Cell line information]: cell: A549:
cancer_type: LUNG: PAM_dist: 9: indel length: 0: CRISPR gRNA ID: GF-CCELg12-124:
[crRNA sequence]: crRNA sequence: TTTTTCTTCAGTGTATGACAAGGCAGCA (SEQ ID NO:
441): LbgRNA: AATTCTAATACGACTCACTATAGgtaatttctactaagtgtagat TABLE 6-continued Illustrative guide RNA sequences for Cas12 comprising poylpeptide TCTTCAGTGTATGACAAGGCAGCA (SEQ ID NO: 442): [Target gene information]: Gene ID:
2271: Symbol: FH: Ensembl_Transcript_ID: ENST00000366560.3: GRCh: 37: Chr: 1: [Target
cancer mutation information]: mut_start: 241661270: mut_end: 241661270: mut_class: Splice_Site:
mut_type: SNP: ref_seq: C: mut_seq: A: mut_aa: p.G464V: mutation info source: CCLE:
ref_target(-10 +10): CTTGTCATACCCTGAAGAAAA (SEQ ID NO: 429): mut_target(-10 +10):
CTTGTCATACACTGAAGAAAA (SEQ ID NO: 430): [Model Cell line information]: cell: A549:
cancer_type: LUNG: PAM_dist: 8: indel length: 0: CRISPR gRNA ID: GF-CCELg12-125:
[crRNA sequence]: crRNA sequence: TTTTCTTCAGTGTATGACAAGGCAGCAA (SEQ ID NO:
443): LbgRNA: AATTCTAATACGACTCACTATAGgtaatttctactaagtgtagat
CTTCAGTGTATGACAAGGCAGCAA (SEQ ID NO: 444): [Target gene information]: Gene ID:
2271: Symbol: FH: Ensembl_Transcript_ID: ENST00000366560.3: GRCh: 37: Chr: 1: [Target
cancer mutation information]: mut_start: 241661270: mut_end: 241661270: mut_class: Splice_Site:
mut_type: SNP: ref_seq: C: mut_seq: A: mut_aa: p.G464V: mutation info source: CCLE:
ref_target(-10 +10): CTTGTCATACCCTGAAGAAAA (SEQ ID NO: 429): mut_target(-10 +10):
CTTGTCATACACTGAAGAAAA (SEQ ID NO: 430): [Model Cell line information]: cell: A549:
cancer_type: LUNG: PAM_dist: 7: indel length: 0: CRISPR gRNA ID: GF-CCELg12-126:
[crRNA sequence]: crRNA sequence: TTTATCTTCTTGAAAGCCGGAGCTCGCA (SEQ ID NO:
445): LbgRNA: AATTCTAATACGACTCACTATAGgtaatttctactaagtgtagat
TCTTCTTGAAAGCCGGAGCTCGCA (SEQ ID NO: 446): [Target gene information]: Gene ID:
2321: Symbol: FLT1: Ensembl_Transcript_ID: ENST00000282397.4: GRCh: 37: Chr: 13:
[Target cancer mutation information]: mut_start: 28896964: mut_end: 28896964: mut_class: Silent:
mut_type: SNP: ref_seq: C: mut_seq: T: mut_aa: p.Q972Q: mutation info source: CCLE:
ref_target(-10 +10): TTTTATCTTCCTGAAAGCCGG (SEQ ID NO: 447): mut_target(-10 +10):
TTTTATCTTCTTGAAAGCCGG (SEQ ID NO: 448): [Model Cell line information]: cell:
NCIH1573: cancer_type: LUNG: PAM_dist: 6: indel length: 0: CRISPR gRNA ID: GF-
CCELg12-127: [crRNA sequence]: crRNA sequence: TTTTATCTTCTTGAAAGCCGGAGCTCGC
(SEQ ID NO: 449): LbgRNA: AATTCTAATACGACTCACTATAGgtaatttctactaagtgtagat
ATCTTCTTGAAAGCCGGAGCTCGC (SEQ ID NO: 450): [Target gene information]: Gene ID:
2321: Symbol: FLT1: Ensembl_Transcript_ID: ENST00000282397.4: GRCh: 37: Chr: 13:
[Target cancer mutation information]: mut_start: 28896964: mut_end: 28896964: mut_class: Silent:
mut_type: SNP: ref_seq: C: mut_seq: T: mut_aa: p.Q972Q: mutation info source: CCLE:
ref_target(-10 +10): TTTTATCTTCCTGAAAGCCGG (SEQ ID NO: 447): mut_target(-10 +10):
TTTTATCTTCTTGAAAGCCGG (SEQ ID NO: 448): [Model Cell line information]: cell:
NCIH1573: cancer_type: LUNG: PAM_dist: 7: indel length: 0: CRISPR gRNA ID: GF-
CCELg12-128: [crRNA sequence]: crRNA sequence:
TTTCAAGAAGATAAAAGTCTGAGTGATG (SEQ ID NO: 451): LbgRNA:
AATTCTAATACGACTCACTATAGgtaatttctactaagtgtagat AAGAAGATAAAAGTCTGAGTGATG
(SEQ ID NO: 452): [Target gene information]: Gene ID: 2321: Symbol: FLT1:
Ensembl_Transcript_ID: ENST00000282397.4: GRCh: 37: Chr: 13: [Target cancer mutation
information]: mut_start: 28896964: mut_end: 28896964: mut_class: Silent: mut_type: SNP:
ref_seq: C: mut_seq: T: mut_aa: p.Q972Q: mutation info source: CCLE: ref_target(-10 +10):
TTTTATCTTCCTGAAAGCCGG (SEQ ID NO: 447): mut_target(-10 +10):
TTTTATCTTCTTGAAAGCCGG (SEQ ID NO: 448): [Model Cell line information]: cell:
NCIH1573: cancer_type: LUNG: PAM_dist: 2: indel length: 0: CRISPR gRNA ID: GF-
CCELg12-129: [crRNA sequence]: crRNA sequence:
TTTGCGAGCTCCGGCTTTCAAGAAGATA (SEQ ID NO: 453): LbgRNA:
AATTCTAATACGACTCACTATAGgtaatttctactaagtgtagat CGAGCTCCGGCTTTCAAGAAGATA
(SEQ ID NO: 454): [Target gene information]: Gene ID: 2321: Symbol: FLT1:
Ensembl_Transcript_ID: ENST00000282397.4: GRCh: 37: Chr: 13: [Target cancer mutation
information]: mut_start: 28896964: mut_end: 28896964: mut_class: Silent: mut_type: SNP:
ref_seq: C: mut_seq: T: mut_aa: p.Q972Q: mutation info source: CCLE: ref_target(-10 +10):
TTTTATCTTCCTGAAAGCCGG (SEQ ID NO: 447): mut_target(-10 +10):
TTTTATCTTCTTGAAAGCCGG (SEQ ID NO: 448): [Model Cell line information]: cell:
NCIH1573: cancer_type: LUNG: PAM_dist: 17: indel length: 0: CRISPR gRNA ID: GF-
CCELg12-130: [crRNA sequence]: crRNA sequence:
TTTTCTTGCCACTGATGATACAAAAGCA (SEQ ID NO: 455): LbgRNA:
AATTCTAATACGACTCACTATAGgtaatttctactaagtgtagat CTTGCCACTGATGATACAAAAGCA
(SEQ ID NO: 456): [Target gene information]: Gene ID: 2322: Symbol: FLT3
Ensembl_Transcript_ID: ENST00000241453.7: GRCh: 37: Chr: 13: [Target cancer mutation
information]: mut_start: 28623588: mut_end: 28623588: mut_class: Missense_Mutation:
mut_type: SNP: ref_seq: G: mut_seq: T: mut_aa: p.N323K: mutation info source: CCLE:
ref_target(-10 +10) ATCCGGTGTCGTTTCTTGCCA (SEQ ID NO: 457): mut_target(-10 +10):
ATCCGGTGTCTTTTCTTGCCA (SEQ ID NO: 458): [Model Cell line information]: cell: A549:
cancer_type: LUNG: PAM_dist -3: indel length: 0: CRISPR gRNA ID: GF-CCELg112-131:
[crRNA sequence]: crRNA sequence: TTTGTATCATCAGTGGCAAGAAAAGACA (SEQ ID NO:
459): LbgRNA: AATTCTAATACGACTCACTATAGgtaatttctactaagtgtagat
TATCATCAGTGGCAAGAAAAGACA (SEQ ID NO: 460): [Target gene information]: Gene ID:
2322: Symbol: FLT3: Ensembl_Transcript_ID: ENST00000241453.7: GRCh: 37: Chr: 13:
[Target cancer mutation information]: mut_start: 28623588: mut_end: 28623588: mut_class:
Missense_Mutation: mut_type: SNP: ref_seq: G: mut_seq: T: mut_aa: p.N323K: mutation info
source: CCLE: ref_target(-10 +10) ATCCGGTGTCGTTTCTTGCCA (SEQ ID NO: 457):
mut_target(-10 +10) ATCCGGTGTCTTTTCTTGCCA (SEQ ID NO: 458): [Model Cell line
information]: cell: A549: cancer_type: LUNG: PAM_dist: 20: indel length: 0: CRISPR gRNA
ID: GF-CCELg12-132: [crRNA sequence]: crRNA sequence:
TTTTGTATCATCAGTGGCAAGAAAAGAC (SEQ ID NO: 461): LbgRNA:
AATTCTAATACGACTCACTATAGgtaatttctactaagtgtagat GTATCATCAGTGGCAAGAAAAGAC
(SEQ ID NO: 462): [Target gene information]: Gene ID: 2322: Symbol: FLT3:
Ensembl_Transcript_ID: ENST00000241453.7: GRCh: 37: Chr: 13: [Target cancer mutation TABLE 6-continued Illustrative guide RNA sequences for Cas12 comprising poylpeptide information]: mut_start: 28623588: mut_end: 28623588: mut_class: Missense_Mutation:
mut_type: SNP: ref_seq: G: mut_seq: T: mut_aa: p.N323K: mutation info source: CCLE:
ref_target(-10 +10) ATCCGGTGTCGTTTCTTGCCA (SEQ ID NO: 457): mut_target(-10 +10):
ATCCGGTGTCTTTTCTTGCCA (SEQ ID NO: 458): [Model Cell line information]: cell: A549:
cancer_type: LUNG: PAM_dist: 21: indel length: 0: CRISPR gRNA ID: GF-CCELg12-133:
[crRNA sequence]: crRNA sequence: TTTTCCATCCTTGTACCTGGCCAGGGAA (SEQ ID NO:
463): LbgRNA: AATTCTAATACGACTCACTATAGgtaatttctactaagtgtagat
CCATCCTTGTACCTGGCCAGGGAA (SEQ ID NO: 464): [Target gene information]: Gene ID:
2324: Symbol: FLT4: Ensembl_Transcript_ID: ENST00000261937.6: GRCh: 37: Chr: 5: [Target
cancer mutation information]: mut_start: 180053250: mut_end: 180053250: mut_class: Silent:
mut_type: SNP: ref_seq: C: mut_seq: T: mut_aa: p.K373K: mutation info source: CCLE:
ref_target(-10 +10): CGGACAGTGCCTTTCCATCCT (SEQ ID NO: 465): mut_target(-10 +10):
CGGACAGTGCTTTTCCATCCT (SEQ ID NO: 466): [Model Cell line information]: cell:
NCIH661: cancer_type: LUNG: PAM_dist: -3: indel length: 0: CRISPR gRNA ID: GF-
CCELg12-134: [crRNA sequence]: crRNA sequence: TTTCACACGAATGTTTGCTTACTTCCGA
(SEQ ID NO: 467): LbgRNA: AATTCTAATACGACTCACTATAGgtaatttctactaagtgtagat
ACACGAATGTTTGCTTACTTCCGA (SEQ ID NO: 468): [Target gene information]: Gene ID:
27086: Symbol: FOXP1: Ensembl_Transcript_ID: ENST00000318789.4: GRCh: 37: Chr: 3:
[Target cancer mutation information]: mut_start: 71026140: mut_end: 71026140: mut_class:
Missense_Mutation: mut_type: SNP: ref_seq: C: mut_seq: A: mut_aa: p.W494C: mutation info
source: CCLE: ref_target(-10 +10): TTCGTGTGAACCAGTTATAGA (SEQ ID NO: 469):
mut_target(-10 +10): TTCGTGTGAAACAGTTATAGA (SEQ ID NO: 470): [Model Cell line
information]: cell: NCIH1573: cancer_type: LUNG: PAM_dist: -3: indel length: 0: CRISPR
gRNA ID: GF-CCELg12-135: [crRNA sequence]: crRNA sequence:
TTTCAACGCTGACCTGAGGTTTCAGAGC (SEQ ID NO: 471): LbgRNA:
AATTCTAATACGACTCACTATAGgtaatttctactaagtgtagat AACGCTGACCTGAGGTTTCAGAGC
(SEQ ID NO: 472): [Target gene information]: Gene ID: 440093: Symbol: H3F3C:
Ensembl_Transcript_ID: ENST00000340398.3: GRCh: 37: Chr: 12: [Target cancer mutation
information]: mut_start: 31944863: mut_end: 31944863: mut_class: Missense_Mutation:
mut_type: SNP: ref_seq: T: mut_seq: C: mut_aa: p.T80A: mutation info source: CCLE:
ref_target(-10 +10): CTCAGGTCAGTGTTGAAATCC (SEQ ID NO: 473): mut_target(-10 +10):
CTCAGGTCAGCGTTGAAATCC (SEQ ID NO: 474): [Model Cell line information]: cell:
NCIH1573: cancer_type: LUNG: PAM_dist: 4: indel length: 0: CRISPR gRNA ID: GF-
CCELg12-136: [crRNA sequence]: crRNA sequence: TTTCGGCAATAATTATCATCAAAGCCCT
(SEQ ID NO: 475): LbgRNA: AATTCTAATACGACTCACTATAGgtaatttctactaagtgtagat
GGCAATAATTATCATCAAAGCCCT (SEQ ID NO: 476): [Target gene information]: Gene ID:
3082: Symbol: HGF: Ensembl_Transcript_ID: ENST00000222390.5: GRCh: 37: Chr: 7: [Target
cancer mutation information]: mut_start: 81372751: mut_end: 81372751: mut_class: Silent:
mut_type: SNP: ref_seq: G: mut_seq: T: mut_aa: p.R261R: mutation info source: CCLE:
ref_target(-10 +10): CATCGGGATTGCGGCAATAAT (SEQ ID NO: 477): mut_target(-10 +10):
CATCGGGATTTCGGCAATAAT (SEQ ID NO: 478): [Model Cell line information]: cell:
NCIH2126: cancer_type: LUNG: PAM_dist: -1: indel length: 0: CRISPR gRNA ID: GF-
CCELg12-137: [crRNA sequence]: crRNA sequence: TTTGATGATAATTATTGCCGAAATCCCG
(SEQ ID NO: 479): LbgRNA: AATTCTAATACGACTCACTATAGgtaatttctactaagtgtagat
ATGATAATTATTGCCGAAATCCCG (SEQ ID NO: 480): [Target gene information]: Gene ID:
3082: Symbol: HGF: Ensembl_Transcript_ID: ENST00000222390.5: GRCh: 37: Chr: 7: [Target
cancer mutation information]: mut_start: 81372751: mut_end: 81372751: mut_class: Silent:
mut_type: SNP: ref_seq: G: mut_seq: T: mut_aa: p.R261R: mutation info source: CCLE:
ref_target(-10 +10): CATCGGGATTGCGGCAATAAT (SEQ ID NO: 477): mut_target(-10 +10):
CATCGGGATTTCGGCAATAAT (SEQ ID NO: 478): [Model Cell line information]: cell:
NCIH2126: cancer_type: LUNG: PAM_dist: 17: indel length: 0: CRISPR gRNA ID: GF-
CCELg12-138: [crRNA sequence]: crRNA sequence: TTTGAATACACCAACCTCTGTGCTATTC
(SEQ ID NO: 481): LbgRNA: AATTCTAATACGACTCACTATAGgtaatttctactaagtgtagat
AATACACCAACCTCTGTGCTATTC (SEQ ID NO: 482): [Target gene information]: Gene ID:
8356: Symbol: HIST1H3J: Ensembl_Transcript_ID: ENST00000359303.2: GRCh: 37: Chr: 6:
[Target cancer mutation information]: mut_start: 27858252: mut_end: 27858252: mut_class:
Missense_Mutation: mut_type: SNP: ref_seq: C: mut_seq: A: mut_aa: p.D107Y: mutation info
source: CCLE: ref_target(-10 +10): AGGTTGGTGTCTTCAAAGAGA (SEQ ID NO: 483):
mut_target(-10 +10): AGGTTGGTGTATTCAAAGAGA (SEQ ID NO: 484): [Model Cell line
information]: cell: NCIH1563: cancer_type: LUNG: PAM_dist: 3: indel length: 0: CRISPR
gRNA ID: GF-CCELg12-139: [crRNA sequence]: crRNA sequence:
TTTGTAGTCCCAAGGCTACGCAGGAGGT (SEQ ID NO: 485): LbgRNA:
AATTCTAATACGACTCACTATAGgtaatttctactaagtgtagat TAGTCCCAAGGCTACGCAGGAGGT
(SEQ ID NO: 486): [Target gene information]: Gene ID: 3575: Symbol: IL7R:
Ensembl_Transcript_ID: ENST00000303115.3: GRCh: 37: Chr: 5: [Target cancer mutation
information]: mut_start: 35876425: mut_end: 35876425: mut_class: Missense_Mutation:
mut_type: SNP: ref_seq: T: mut_seq: G: mut_aa: p.L406R: mutation info source: CCLE:
ref_target(-10 +10): GACCTCCTGCTTAGCCTTGGG (SEQ ID NO: 487): mut_target(-10 +10):
GACCTCCTGCGTAGCCTTGGG (SEQ ID NO: 488): [Model Cell line information]: cell:
NCIH2126: cancer_type: LUNG: PAM_dist: 15: indel length: 0: CRISPR gRNA ID: GF-
CCELg12-140: [crRNA sequence]: crRNA sequence:
TTTGTTCCTGAAAATGCGAAATATCTGA (SEQ ID NO: 489): LbgRNA:
AATTCTAATACGACTCACTATAGgtaatttctactaagtgtagat TTCCTGAAAATGCGAAATATCTGA
(SEQ ID NO: 490): [Target gene information]: Gene ID: 8821: Symbol: INPP4B:
Ensembl_Transcript_ID: ENST00000513000.1: GRCh: 37: Chr: 4: [Target cancer mutation
information]: mut_start: 143007402: mut_end: 143007402: mut_class: Silent: mut_type: SNP:
ref_seq: T: mut_seq: C: mut_aa: p.S794S: mutation info source: CCLE: ref_target(-10 +10):
CCTGAAAATGTGAAATATCTG (SEQ ID NO: 491): mut_target(-10 +10):

TABLE 6-continued

Illustrative guide RNA sequences for Cas12 comprising poylpeptide

CCTGAAAATG<u>C</u>GAAATATCTG (SEQ ID NO: 492): [Model Cell line information]: cell:
NCIH2126: cancer_type: LUNG: PAM_dist: 13: indel length: 0: CRISPR gRNA ID: GF-
CCELg12-141: [crRNA sequence]: crRNA sequence: TTTAAATCATTTTGTTCCTGAAAATG<u>C</u>G
(SEQ ID NO: 493): LbgRNA: AATTCTAATACGACTCACTATAGgtaatttctactaagtgtagat
AATCATTTTGTTCCTGAAAATGCG (SEQ ID NO: 494): [Target gene information]: Gene ID:
8821: Symbol: INPP4B: Ensembl_Transcript_ID: ENST00000513000.1: GRCh: 37: Chr: 4:
[Target cancer mutation information]: mut_start: 143007402: mut_end: 143007402: mut_class:
Silent: mut_type: SNP: ref_seq: T: mut_seq: C: mut_aa: p.S794S: mutation info source: CCLE:
ref_target(-10 +10): CCTGAAAATG<u>T</u>GAAATATCTG (SEQ ID NO: 491): mut_target(-10 +10):
CCTGAAAATG<u>C</u>GAAATATCTG (SEQ ID NO: 492): [Model Cell line information]: cell:
NCIH2126: cancer_type: LUNG: PAM_dist: 23: indel length: 0: CRISPR gRNA ID: GF-
CCELg12-142: [crRNA sequence]: crRNA sequence: TTTTAAATCATTTTGTTCCTGAAAATG<u>C</u>
(SEQ ID NO: 495): LbgRNA: AATTCTAATACGACTCACTATAGgtaatttctactaagtgtagat
AAATCATTTTGTTCCTGAAAATGC (SEQ ID NO: 496): [Target gene information]: Gene ID:
8821: Symbol: INPP4B: Ensembl_Transcript_ID: ENST00000513000.1: GRCh: 37: Chr: 4:
[Target cancer mutation information]: mut_start: 143007402: mut_end: 143007402: mut_class:
Silent: mut_type: SNP: ref_seq: T: mut_seq: C: mut_aa: p.S794S: mutation info source: CCLE:
ref_target(-10 +10): CCTGAAAATG<u>T</u>GAAATATCTG (SEQ ID NO: 491): mut_target(-10 +10):
CCTGAAAATG<u>C</u>GAAATATCTG (SEQ ID NO: 492): [Model Cell line information]: cell:
NCIH2126: cancer_type: LUNG: PAM_dist: 24: indel length: 0: CRISPR gRNA ID: GF-
CCELg12-143: [crRNA sequence]: crRNA sequence: TTTTGTTCCTGAAAATG<u>C</u>GAAATATCTG
(SEQ ID NO: 497): LbgRNA: AATTCTAATACGACTCACTATAGgtaatttctactaagtgtagat
GTTCCTGAAAATGCGAAATATCTG (SEQ ID NO: 498): [Target gene information]: Gene ID:
8821: Symbol: INPP4B: Ensembl_Transcript_ID: ENST00000513000.1: GRCh: 37: Chr: 4:
[Target cancer mutation information]: mut_start: 143007402: mut_end: 143007402: mut_class:
Silent: mut_type: SNP: ref_seq: T: mut_seq: C: mut_aa: p.S794S: mutation info source: CCLE:
ref_target(-10 +10): CCTGAAAATG<u>T</u>GAAATATCTG (SEQ ID NO: 491): mut_target(-10 +10):
CCTGAAAATG<u>C</u>GAAATATCTG (SEQ ID NO: 492): [Model Cell line information]: cell:
NCIH2126: cancer_type: LUNG: PAM_dist: 14: indel length: 0: CRISPR gRNA ID: GF-
CCELg12-144: [crRNA sequence]: crRNA sequence: TTTCCCCTTCAGATATTTC<u>G</u>CATTTTCA
(SEQ ID NO: 499): LbgRNA: AATTCTAATACGACTCACTATAGgtaatttctactaagtgtagat
CCCTTCAGATATTTCGCATTTTCA (SEQ ID NO: 500): [Target gene information]: Gene ID:
8821: Symbol: INPP4B: Ensembl_Transcript_ID: ENST00000513000.1: GRCh: 37: Chr: 4:
[Target cancer mutation information]: mut_start: 143007402: mut_end: 143007402: mut_class:
Silent: mut_type: SNP: ref_seq: T: mut_seq: C: mut_aa: p.S794S: mutation info source: CCLE:
ref_target(-10 +10): CCTGAAAATG<u>T</u>GAAATATCTG (SEQ ID NO: 491): mut_target(-10 +10):
CCTGAAAATG<u>C</u>GAAATATCTG (SEQ ID NO: 492): [Model Cell line information]: cell:
NCIH2126: cancer_type: LUNG: PAM_dist: 16: indel length: 0: CRISPR gRNA ID: GF-
CCELg12-145: [crRNA sequence]: crRNA sequence: TTTC<u>G</u>CATTTTCAGGAACAAAATGATTT
(SEQ ID NO: 501): LbgRNA: AATTCTAATACGACTCACTATAGgtaatttctactaagtgtagat
GCATTTTCAGGAACAAAATGATTT (SEQ ID NO: 502): [Target gene information]: Gene ID:
8821: Symbol: INPP4B: Ensembl_Transcript_ID: ENST00000513000.1: GRCh: 37: Chr: 4:
[Target cancer mutation information]: mut_start: 143007402: mut_end: 143007402: mut_class:
Silent: mut_type: SNP: ref_seq: T: mut_seq: C: mut_aa: p.S794S: mutation info source: CCLE:
ref_target(-10 +10): CCTGAAAATG<u>T</u>GAAATATCTG (SEQ ID NO: 491): mut_target(-10 +10):
CCTGAAAATG<u>C</u>GAAATATCTG (SEQ ID NO: 492): [Model Cell line information]: cell:
NCIH2126: cancer_type: LUNG: PAM_dist: 1: indel length: 0: CRISPR gRNA ID: GF-
CCELg12-146: [crRNA sequence]: crRNA sequence: TTTGTTTTTTCCCCTTCAGATATTTCGC
(SEQ ID NO: 503): LbgRNA: AATTCTAATACGACTCACTATAGgtaatttctactaagtgtagat
TTTTTTTCCCCTTCAGATATTTCGC (SEQ ID NO: 504): [Target gene information]: Gene ID:
8821: Symbol: INPP4B: Ensembl_Transcript_ID: ENST00000513000.1: GRCh: 37: Chr: 4:
[Target cancer mutation information]: mut_start: 143007402: mut_end: 143007402: mut_class:
Silent: mut_type: SNP: ref_seq: T: mut_seq: C: mut_aa: p.S794S: mutation info source: CCLE:
ref_target(-10 +10): CCTGAAAATG<u>T</u>GAAATATCTG (SEQ ID NO: 491): mut_target(-10 +10):
CCTGAAAATG<u>C</u>GAAATATCTG (SEQ ID NO: 492): [Model Cell line information]: cell:
NCIH2126: cancer_type: LUNG: PAM_dist: 23: indel length: 0: CRISPR gRNA ID: GF-
CCELg12-147: [crRNA sequence]: crRNA sequence: TTTTTTCCCCTTCAGATATTTC<u>G</u>CATTT
(SEQ ID NO: 505): LbgRNA: AATTCTAATACGACTCACTATAGgtaatttctactaagtgtagat
TTCCCCTTCAGATATTTCGCATTT (SEQ ID NO: 506): [Target gene information]: Gene ID:
8821: Symbol: INPP4B: Ensembl_Transcript_ID: ENST00000513000.1: GRCh: 37: Chr: 4:
[Target cancer mutation information]: mut_start: 143007402: mut_end: 143007402: mut_class:
Silent: mut_type: SNP: ref_seq: T: mut_seq: C: mut_aa: p.S794S: mutation info source: CCLE:
ref_target(-10 +10): CCTGAAAATG<u>T</u>GAAATATCTG (SEQ ID NO: 491): mut_target(-10 +10):
CCTGAAAATG<u>C</u>GAAATATCTG (SEQ ID NO: 492): [Model Cell line information]: cell:
NCIH2126: cancer_type: LUNG: PAM_dist: 19: indel length: 0: CRISPR gRNA ID: GF-
CCELg12-148: [crRNA sequence]: crRNA sequence: TTTTTCCCCTTCAGATATTTC<u>G</u>CATTTT
(SEQ ID NO: 507): LbgRNA: AATTCTAATACGACTCACTATAGgtaatttctactaagtgtagat
TCCCCTTCAGATATTTCGCATTTT (SEQ ID NO: 508): [Target gene information]: Gene ID:
8821: Symbol: INPP4B: Ensembl_Transcript_ID: ENST00000513000.1: GRCh: 37: Chr: 4:
[Target cancer mutation information]: mut_start: 143007402: mut_end: 143007402: mut_class:
Silent: mut_type: SNP: ref_seq: T: mut_seq: C: mut_aa: p.S794S: mutation info source: CCLE:
ref_target(-10 +10): CCTGAAAATG<u>T</u>GAAATATCTG (SEQ ID NO: 491): mut_target(-10 +10):
CCTGAAAATG<u>C</u>GAAATATCTG (SEQ ID NO: 492): [Model Cell line information]: cell:
NCIH2126: cancer_type: LUNG: PAM_dist: 18: indel length: 0: CRISPR gRNA ID: GF-
CCELg12-149: [crRNA sequence]: crRNA sequence: TTTTCCCCTTCAGATATTTC<u>G</u>CATTTTC
(SEQ ID NO: 509): LbgRNA: AATTCTAATACGACTCACTATAGgtaatttctactaagtgtagat
CCCCTTCAGATATTTCGCATTTTC (SEQ ID NO: 510): [Target gene information]: Gene ID:
8821: Symbol: INPP4B: Ensembl_Transcript_ID: ENST00000513000.1: GRCh: 37: Chr: 4:

TABLE 6-continued

Illustrative guide RNA sequences for Cas12 comprising poylpeptide

[Target cancer mutation information]: mut_start: 143007402: mut_end: 143007402: mut_class: Silent: mut_type: SNP: ref_seq: T: mut_seq: C: mut_aa: p.S794S: mutation info source: CCLE: ref_target(-10 +10): CCTGAAAATGTGAAATATCTG (SEQ ID NO: 491): mut_target(-10 +10): CCTGAAAATGCGAAATATCTG (SEQ ID NO: 492): [Model Cell line information]: cell: NCIH2126: cancer_type: LUNG: PAM_dist: 17: indel length: 0: CRISPR gRNA ID: GF-CCELg12-150: [crRNA sequence]: crRNA sequence: TTTGCTTAGGTAGGAAGTTTGGGCCCAG (SEQ ID NO: 511): LbgRNA: AATTCTAATACGACTCACTATAGgtaatttctactaagtgtagat CTTAGGTAGGAAGTTTGGGCCCAG (SEQ ID NO: 512): [Target gene information]: Gene ID: 3716: Symbol: JAK1: Ensembl_Transcript_ID: ENST00000342505.4: GRCh: 37: Chr: 1: [Target cancer mutation information]: mut_start: 65339055: mut_end: 65339055: mut_class: Nonsense_Mutation: mut_type: SNP: ref_seq: G: mut_seq: A: mut_aa: p.Q161*: mutation info source: CCLE: ref_target(-10 +10): CTTCCTACCTGAGCAAACAGA (SEQ ID NO: 513): mut_target(-10 +10): CTTCCTACCTAAGCAAACAGA (SEQ ID NO: 514): [Model Cell line information]: cell: NCIH1563: cancer_type: LUNG: PAM_dist: 3: indel length: 0: CRISPR gRNA ID: GF-CCELg12-151: [crRNA sequence]: crRNA sequence: TTTCAGATAAATGAAACCTTCTAGTCTT (SEQ ID NO: 515): LbgRNA: AATTCTAATACGACTCACTATAGgtaatttctactaagtgtagat AGATAAATGAAACCTTCTAGTCTT (SEQ ID NO: 516): [Target gene information]: Gene ID: 3717: Symbol: JAK2: Ensembl_Transcript_ID: ENST00000381652.3: GRCh: 37: Chr: 9: [Target cancer mutation information]: mut_start: 5069931: mut_end: 5069931: mut_class: Nonsense_Mutation: mut_type: SNP: ref_seq: C: mut_seq: G: mut_aa: p.S507*: mutation info source: CCLE: ref_target(-10 +10): TCAGATAAATCAAACCTTCTA (SEQ ID NO: 517): mut_target(-10 +10): TCAGATAAATGAAACCTTCTA (SEQ ID NO: 518): [Model Cell line information]: cell: NCIH1573: cancer_type: LUNG: PAM_dist: 9: indel length: 0: CRISPR gRNA ID: GF-CCELg12-152: [crRNA sequence]: crRNA sequence: TTTATTTTTCAGATAAATGAAACCTTC (SEQ ID NO: 519): LbgRNA: AATTCTAATACGACTCACTATAGgtaatttctactaagtgtagat TTTTTTCAGATAAATGAAACCTTC (SEQ ID NO: 520): [Target gene information]: Gene ID: 3717: Symbol: JAK2: Ensembl_Transcript_ID: ENST00000381652.3: GRCh: 37: Chr: 9: [Target cancer mutation information]: mut_start: 5069931: mut_end: 5069931: mut_class: Nonsense_Mutation: mut_type: SNP: ref_seq: C: mut_seq: G: mut_aa: p.S507*: mutation info source: CCLE: ref_target(-10 +10): TCAGATAAATCAAACCTTCTA (SEQ ID NO: 517): mut_target(-10 +10): TCAGATAAATGAAACCTTCTA (SEQ ID NO: 518): [Model Cell line information]: cell: NCIH1573: cancer_type: LUNG: PAM_dist: 16: indel length: 0: CRISPR gRNA ID: GF-CCELg12-153: [crRNA sequence]: crRNA sequence: TTTTATTTTTCAGATAAATGAAACCTT (SEQ ID NO: 521): LbgRNA: AATTCTAATACGACTCACTATAGgtaatttctactaagtgtagat ATTTTTTCAGATAAATGAAACCTT (SEQ ID NO: 522): [Target gene information]: Gene ID: 3717: Symbol: JAK2: Ensembl_Transcript_ID: ENST00000381652.3: GRCh: 37: Chr: 9: [Target cancer mutation information]: mut_start: 5069931: mut_end: 5069931: mut_class: Nonsense_Mutation: mut_type: SNP: ref_seq: C: mut_seq: G: mut_aa: p.S507*: mutation info source: CCLE: ref_target(-10 +10): TCAGATAAATCAAACCTTCTA (SEQ ID NO: 517): mut_target(-10 +10): TCAGATAAATGAAACCTTCTA (SEQ ID NO: 518): [Model Cell line information]: cell: NCIH1573: cancer_type: LUNG: PAM_dist: 17: indel length: 0: CRISPR gRNA ID: GF-CCELg12-154: [crRNA sequence]: crRNA sequence: TTTTTTCAGATAAATGAAACCTTCTAGT (SEQ ID NO: 523): LbgRNA: AATTCTAATACGACTCACTATAGgtaatttctactaagtgtagat TTCAGATAAATGAAACCTTCTAGT (SEQ ID NO: 524): [Target gene information]: Gene ID: 3717: Symbol: JAK2: Ensembl_Transcript_ID: ENST00000381652.3: GRCh: 37: Chr: 9: [Target cancer mutation information]: mut_start: 5069931: mut_end: 5069931: mut_class: Nonsense_Mutation: mut_type: SNP: ref_seq: C: mut_seq: G: mut_aa: p.S507*: mutation info source: CCLE: ref_target(-10 +10): TCAGATAAATCAAACCTTCTA (SEQ ID NO: 517): mut_target(-10 +10): TCAGATAAATGAAACCTTCTA (SEQ ID NO: 518): [Model Cell line information]: cell: NCIH1573: cancer_type: LUNG: PAM_dist: 12: indel length: 0: CRISPR gRNA ID: GF-CCELg12-155: [crRNA sequence]: crRNA sequence: TTTTTCAGATAAATGAAACCTTCTAGTC (SEQ ID NO: 525): LbgRNA: AATTCTAATACGACTCACTATAGgtaatttctactaagtgtagat TCAGATAAATGAAACCTTCTAGTC (SEQ ID NO: 526): [Target gene information]: Gene ID: 3717: Symbol: JAK2: Ensembl_Transcript_ID: ENST00000381652.3: GRCh: 37: Chr: 9: [Target cancer mutation information]: mut_start: 5069931: mut_end: 5069931: mut_class: Nonsense_Mutation: mut_type: SNP: ref_seq: C: mut_seq: G: mut_aa: p.S507*: mutation info source: CCLE: ref_target(-10 +10): TCAGATAAATCAAACCTTCTA (SEQ ID NO: 517): mut_target(-10 +10): TCAGATAAATGAAACCTTCTA (SEQ ID NO: 518): [Model Cell line information]: cell: NCIH1573: cancer_type: LUNG: PAM_dist: 11: indel length: 0: CRISPR gRNA ID: GF-CCELg12-156: [crRNA sequence]: crRNA sequence: TTTTCAGATAAATGAAACCTTCTAGTCT (SEQ ID NO: 527): LbgRNA: AATTCTAATACGACTCACTATAGgtaatttctactaagtgtagat CAGATAAATGAAACCTTCTAGTCT (SEQ ID NO: 528): [Target gene information]: Gene ID: 3717: Symbol: JAK2: Ensembl_Transcript_ID: ENST00000381652.3: GRCh: 37: Chr: 9: [Target cancer mutation information]: mut_start: 5069931: mut_end: 5069931: mut_class: Nonsense_Mutation: mut_type: SNP: ref_seq: C: mut_seq: G: mut_aa: p.S507*: mutation info source: CCLE: ref_target(-10 +10): TCAGATAAATCAAACCTTCTA (SEQ ID NO: 517): mut_target(-10 +10): TCAGATAAATGAAACCTTCTA (SEQ ID NO: 518): [Model Cell line information]: cell: NCIH1573: cancer_type: LUNG: PAM_dist: 10: indel length: 0: CRISPR gRNA ID: GF-CCELg12-157: [crRNA sequence]: crRNA sequence: TTTCATTTATCTGAAAAAATAAAATACA (SEQ ID NO: 529): LbgRNA: AATTCTAATACGACTCACTATAGgtaatttctactaagtgtagat ATTTATCTGAAAAAATAAAATACA (SEQ ID NO: 530): [Target gene information]: Gene ID: 3717: Symbol: JAK2: Ensembl_Transcript_ID: ENST00000381652.3: GRCh: 37: Chr: 9: [Target cancer mutation information]: mut_start: 5069931: mut_end: 5069931: mut_class: Nonsense_Mutation: mut_type:

TABLE 6-continued

Illustrative guide RNA sequences for Cas12 comprising poylpeptide

SNP: ref_seq: C: mut_seq: G: mut_aa: p.S507*: mutation info source: CCLE: ref_target(-10
+10): TCAGATAAATCAAACCTTCTA (SEQ ID NO: 517): mut_target(-10 +10):
TCAGATAAATGAAACCTTCTA (SEQ ID NO: 518): [Model Cell line information]: cell:
NCIH1573: cancer_type: LUNG: PAM_dist: 0: indel length: 0: CRISPR gRNA ID: GF-
CCELg12-158: [crRNA sequence]: crRNA sequence: TTTGACAGCTTCCTCCTCACTGTATGTG
(SEQ ID NO: 531): LbgRNA: AATTCTAATACGACTCACTATAGgtaatttctactaagtgtagat
ACAGCTTCCTCCTCACTGTATGTG (SEQ ID NO: 532): [Target gene information]: Gene ID:
3718: Symbol: JAK3: Ensembl_Transcript_ID: ENST00000527670.1: GRCh: 37: Chr: 19:
[Target cancer mutation information]: mut_start: 17951048: mut_end: 17951048: mut_class: Silent:
mut_type: SNP: ref_seq: G: mut_seq: T: mut_aa: p.V415V: mutation info source: CCLE:
ref_target(-10 +10): CCTGGACACAGACAGTGAGGA (SEQ ID NO: 533): mut_target(-10 +10):
CCTGGACACATACAGTGAGGA (SEQ ID NO: 534): [Model Cell line information]: cell:
NCIH1975: cancer_type: LUNG: PAM_dist: 20: indel length: 0: CRISPR gRNA ID: GF-
CCELg12-159: [crRNA sequence]: crRNA sequence: TTTCTGGTGTAGTATAATCAGGGGCACT
(SEQ ID NO: 535): LbgRNA: AATTCTAATACGACTCACTATAGgtaatttctactaagtgtagat
TGGTGTAGTATAATCAGGGGCACT (SEQ ID NO: 536): [Target gene information]: Gene ID:
3791: Symbol: KDR: Ensembl_Transcript_ID: ENST00000263923.4: GRCh: 37: Chr: 4: [Target
cancer mutation information]: mut_start: 55955567: mut_end: 55955567: mut_class:
Missense_Mutation: mut_type: SNP: ref_seq: C: mut_seq: A: mut_aa: p.R1126S: mutation info
source: CCLE: ref_target(-10 +10): AATCAGGGGCCCTCATTCTAG (SEQ ID NO: 537):
mut_target(-10 +10): AATCAGGGGCACTCATTCTAG (SEQ ID NO: 538): [Model Cell line
information]: cell: NCIH1573: cancer_type: LUNG: PAM_dist: 22: indel length: 0: CRISPR
gRNA ID: GF-CCELg12-160: [crRNA sequence]: crRNA sequence:
TTTCGCCCGGCTCGAGGTGCAGGATGCG   (SEQ ID NO: 539): LbgRNA:
AATTCTAATACGACTCACTATAGgtaatttctactaagtgtagat GCCCGGCTCGAGGTGCAGGATGCG
(SEQ ID NO: 540): [Target gene information]: Gene ID: 3791: Symbol: KDR:
Ensembl_Transcript_ID: ENST00000263923.4: GRCh: 37: Chr: 4: [Target cancer mutation
information]: mut_start: 55991456: mut_end: 55991456: mut_class: Missense_Mutation:
mut_type: SNP: ref_seq: T: mut_seq: C: mut_aa: p.Q2R: mutation info source: CCLE:
ref_target(-10 +10): CACCTTGCTCTGCATCCTGCA (SEQ ID NO: 541): mut_target(-10 +10):
CACCTTGCTCCGCATCCTGCA (SEQ ID NO: 542): [Model Cell line information]: cell:
NCIH2126: cancer_type: LUNG: PAM_dist: 24: indel length: 0: CRISPR gRNA ID: GF-
CCELg12-161: [crRNA sequence]: crRNA sequence: TTTGTTATAGGTAAATGCTTGGCTTTCT
(SEQ ID NO: 543): LbgRNA: AATTCTAATACGACTCACTATAGgtaatttctactaagtgtagat
TTATAGGTAAATGCTTGGCTTTCT (SEQ ID NO: 544): [Target gene information]: Gene ID:
3815: Symbol: KIT: Ensembl_Transcript_ID: ENST00000288135.5: GRCh: 37: Chr: 4: [Target
cancer mutation information]: mut_start: 55561945: mut_end: 55561945: mut_class:
Missense_Mutation: mut_type: SNP: ref_seq: G: mut_seq: T: mut_aa: p.R112I: mutation info
source: CCLE: ref_target(-10 +10): GTGTTTGTTAGAGGTAAATGC (SEQ ID NO: 545):
mut_target(-10 +10): GTGTTTGTTATAGGTAAATGC (SEQ ID NO: 546): [Model Cell line
information]: cell: NCIH1573: cancer_type: LUNG: PAM_dist: 4: indel length: 0: CRISPR
gRNA ID: GF-CCELg12-162: [crRNA sequence]: crRNA sequence:
TTTATGTGTTTGTTATAGGTAAATGCTT (SEQ ID NO: 547): LbgRNA:
AATTCTAATACGACTCACTATAGgtaatttctactaagtgtagat TGTGTTTGTTATAGGTAAATGCTT
(SEQ ID NO: 548): [Target gene information]: Gene ID: 3815: Symbol: KIT:
Ensembl_Transcript_ID: ENST00000288135.5: GRCh: 37: Chr: 4: [Target cancer mutation
information]: mut_start: 55561945: mut_end: 55561945: mut_class: Missense_Mutation:
mut_type: SNP: ref_seq: G: mut_seq: T: mut_aa: p.R112I: mutation info source: CCLE:
ref_target(-10 +10): GTGTTTGTTAGAGGTAAATGC (SEQ ID NO: 545): mut_target(-10 +10):
GTGTTTGTTATAGGTAAATGC (SEQ ID NO: 546): [Model Cell line information]: cell:
NCIH1573: cancer_type: LUNG: PAM_dist: 12: indel length: 0: CRISPR gRNA ID: GF-
CCELg12-163: [crRNA sequence]: crRNA sequence:
TTTACCTATAACAAACACATAAATGGAA (SEQ ID NO: 549): LbgRNA:
AATTCTAATACGACTCACTATAGgtaatttctactaagtgtagat CCTATAACAAACACATAAATGGAA
(SEQ ID NO: 550): [Target gene information]: Gene ID: 3815: Symbol: KIT:
Ensembl_Transcript_ID: ENST00000288135.5: GRCh: 37: Chr: 4: [Target cancer mutation
information]: mut_start: 55561945: mut_end: 55561945: mut_class: Missense_Mutation:
mut_type: SNP: ref_seq: G: mut_seq: T: mut_aa: p.R112I: mutation info source: CCLE:
ref_target(-10 +10): GTGTTTGTTAGAGGTAAATGC (SEQ ID NO: 545): mut_target(-10 +10):
GTGTTTGTTATAGGTAAATGC (SEQ ID NO: 546): [Model Cell line information]: cell:
NCIH1573: cancer_type: LUNG: PAM_dist: 4: indel length: 0: CRISPR gRNA ID: GF-
CCELg12-164: [crRNA sequence]: crRNA sequence:
TTTCTTAGAACTATTGCCATTGGAGAGA (SEQ ID NO: 551): LbgRNA:
AATTCTAATACGACTCACTATAGgtaatttctactaagtgtagat TTAGAACTATTGCCATTGGAGAGA
(SEQ ID NO: 552): [Target gene information]: Gene ID: 4297: Symbol: KMT2A:
Ensembl_Transcript_ID: ENST00000389506.5: GRCh: 37: Chr: 11: [Target cancer mutation
information]: mut_start: 118354982: mut_end: 118354983: mut_class: Frame_Shift_Ins:
mut_type: INS: ref_seq: -: mut_seq: A: mut_aa: p.Q1391fs: mutation info source: CCLE:
ref_target(-10 +10): TAGTTCTAAG-AAAAATTCCA (SEQ ID NO: 105): mut_target(-10 +10):
TAGTTCTAAGAAAAAATTCCA (SEQ ID NO: 95): [Model Cell line information]: cell:
NCIH2126: cancer_type: LUNG: PAM_dist: -1: indel length: 1: CRISPR gRNA ID: GF-
CCELg12-165: [crRNA sequence]: crRNA sequence: TTTTTTCTTAGAACTATTGCCATTGGAG
(SEQ ID NO: 89): LbgRNA: AATTCTAATACGACTCACTATAGgtaatttctactaagtgtagat
TTCTTAGAACTATTGCCATTGGAG (SEQ ID NO: 98): [Target gene information]: Gene ID:
4297: Symbol: KMT2A: Ensembl_Transcript_ID: ENST00000389506.5: GRCh: 37: Chr: 11:
[Target cancer mutation information]: mut_start: 118354982: mut_end: 118354983: mut_class:
Frame_Shift_Ins: mut_type: INS: ref_seq: -: mut_seq: A: mut_aa: p.Q1391fs: mutation info
source: CCLE: ref_target(-10 +10): TAGTTCTAAG-AAAAATTCCA (SEQ ID NO: 105):

TABLE 6-continued

Illustrative guide RNA sequences for Cas12 comprising poylpeptide mut_target(-10 +10): TAGTTCTAAGAAAAAATTCCA (SEQ ID NO: 95): [Model Cell line
information]: cell: NCIH2126: cancer_type: LUNG: PAM_dist: 2: indel length: 1: CRISPR
gRNA ID: GF-CCELg12-166: [crRNA sequence]: crRNA sequence:
TTTTTCTTAGAACTATTGCCATTGGAGA (SEQ ID NO: 553): LbgRNA:
AATTCTAATACGACTCACTATAGgtaatttctactaagtgtagat TCTTAGAACTATTGCCATTGGAGA
(SEQ ID NO: 554): [Target gene information]: Gene ID: 4297: Symbol: KMT2A:
Ensembl_Transcript_ID: ENST00000389506.5: GRCh: 37: Chr: 11: [Target cancer mutation
information]: mut_start: 118354982: mut_end: 118354983: mut_class: Frame_Shift_Ins:
mut_type: INS: ref_seq: -: mut_seq: A: mut_aa: p.Q1391fs: mutation info source: CCLE:
ref_target(-10 +10): TAGTTCTAAG-AAAAATTCCA (SEQ ID NO: 105): mut_target(-10 +10):
TAGTTCTAAGAAAAAATTCCA (SEQ ID NO: 95): [Model Cell line information]: cell:
NCIH2126: cancer_type: LUNG: PAM_dist: 1: indel length: 1: CRISPR gRNA ID: GF-
CCELg12-167: [crRNA sequence]: crRNA sequence: TTTTCTTAGAACTATTGCCATTGGAGAG
(SEQ ID NO: 555): LbgRNA: AATTCTAATACGACTCACTATAGgtaatttctactaagtgtagat
CTTAGAACTATTGCCATTGGAGAG (SEQ ID NO: 556): [Target gene information]: Gene ID:
4297: Symbol: KMT2A: Ensembl_Transcript_ID: ENST00000389506.5: GRCh: 37: Chr: 11:
[Target cancer mutation information]: mut_start: 118354982: mut_end: 118354983: mut_class:
Frame_Shift_Ins: mut_type: INS: ref_seq: -: mut_seq: A: mut_aa: p.Q1391fs: mutation info
source: CCLE: ref_target(-10 +10): TAGTTCTAAG-AAAAATTCCA (SEQ ID NO: 105):
mut_target(-10 +10): TAGTTCTAAGAAAAAATTCCA (SEQ ID NO: 95): [Model Cell line
information]: cell: NCIH2126: cancer_type: LUNG: PAM_dist: 0: indel length: 1: CRISPR
gRNA ID: GF-CCELg12-168: [crRNA sequence]: crRNA sequence:
TTTGCTACATTTTCCACTTCTTCCTCAG (SEQ ID NO: 557): LbgRNA:
AATTCTAATACGACTCACTATAGgtaatttctactaagtgtagat CTACATTTTCCACTTCTTCCTCAG
(SEQ ID NO: 558): [Target gene information]: Gene ID: 58508: Symbol: KMT2C:
Ensembl_Transcript_ID: ENST00000262189.6: GRCh: 37: Chr: 7: [Target cancer mutation
information]: mut_start: 151919709: mut_end: 151919709: mut_class: Missense_Mutation:
mut_type: SNP: ref_seq: C: mut_seq: T: mut_aa: p.D1128N: mutation info source: CCLE:
ref_target(-10 +10): AAACCAATGTCTGCTACATTT (SEQ ID NO: 559): mut_target(-10 +10):
AAACCAATGTTTGCTACATTT (SEQ ID NO: 560): [Model Cell line information]: cell:
NCIH1437: cancer_type: LUNG: PAM_dist: -2: indel length: 0: CRISPR gRNA ID: GF-
CCELg12-169: [crRNA sequence]: crRNA sequence:
TTTGCTGAGCAGCATACCCCGGTGTGTA (SEQ ID NO: 561): LbgRNA:
AATTCTAATACGACTCACTATAGgtaatttctactaagtgtagat CTGAGCAGCATACCCCGGTGTGTA
(SEQ ID NO: 562): [Target gene information]: Gene ID: 8085: Symbol: KMT2D:
Ensembl_Transcript_ID: ENST00000301067.7: GRCh: 37: Chr: 12: [Target cancer mutation
information]: mut_start: 49446729: mut_end: 49446729: mut_class: Missense_Mutation:
mut_type: SNP: ref_seq: C: mut_seq: A: mut_aa: p.V361F: mutation info source: CCLE:
ref_target(-10 +10): TGCTCAGCAACGGAGCGGATA (SEQ ID NO: 563): mut_target(-10 +10):
TGCTCAGCAAAGGAGCGGATA (SEQ ID NO: 564): [Model Cell line information]: cell:
NCIH1573: cancer_type: LUNG: PAM_dist: -3: indel length: 0: CRISPR gRNA ID: GF-
CCELg12-170: [crRNA sequence]: crRNA sequence:
TTTATTGAAACATCAGCCAAGACAAGAC (SEQ ID NO: 565): LbgRNA:
AATTCTAATACGACTCACTATAGgtaatttctactaagtgtagat TTGAAACATCAGCCAAGACAAGAC
(SEQ ID NO: 566): [Target gene information]: Gene ID: 3845: Symbol: KRAS:
Ensembl_Transcript_ID: ENST00000256078.4: GRCh: 37: Chr: 12: [Target cancer mutation
information]: mut_start: 25378560: mut_end: 25378560: mut_class: Silent: mut_type: SNP:
ref_seq: T: mut_seq: G: mut_aa: p.A146A: mutation info source: CCLE: ref_target(-10 +10):
GTCTTGTCTTTGCTGATGTTT (SEQ ID NO: 567): mut_target(-10 +10):
GTCTTGTCTTGGCTGATGTTT (SEQ ID NO: 568): [Model Cell line information]: cell: CFPAC1:
cancer_type: PANCREAS: PAM_dist: 14: indel length: 0: CRISPR gRNA ID: GF-CCELg12-
171: [crRNA sequence]: crRNA sequence: TTTTATTGAAACATCAGCCAAGACAAGA (SEQ ID
NO: 569): LbgRNA: AATTCTAATACGACTCACTATAGgtaatttctactaagtgtagat
ATTGAAACATCAGCCAAGACAAGA (SEQ ID NO: 570): [Target gene information]: Gene ID:
3845: Symbol: KRAS: Ensembl_Transcript_ID: ENST00000256078.4: GRCh: 37: Chr: 12:
[Target cancer mutation information]: mut_start: 25378560: mut_end: 25378560: mut_class: Silent:
mut_type: SNP: ref_seq: T: mut_seq: G: mut_aa: p.A146A: mutation info source: CCLE:
ref_target(-10 +10): GTCTTGTCTTTGCTGATGTTT (SEQ ID NO: 567): mut_target(-10 +10):
GTCTTGTCTTGGCTGATGTTT (SEQ ID NO: 568): [Model Cell line information]: cell: CFPAC1:
cancer_type: PANCREAS: PAM_dist: 15: indel length: 0: CRISPR gRNA ID: GF-CCELg12-
172: [crRNA sequence]: crRNA sequence: TTTAAAAAATGGATGAGCATTTATTTCA (SEQ ID
NO: 571): LbgRNA: AATTCTAATACGACTCACTATAGgtaatttctactaagtgtagat
AAAAATGGATGAGCATTTATTCA (SEQ ID NO: 572): [Target gene information]: Gene ID:
9113: Symbol: LATS1: Ensembl_Transcript_ID: ENST00000543571.1: GRCh: 37: Chr: 6:
[Target cancer mutation information]: mut_start: 149983243: mut_end: 149983243: mut_class:
Missense_Mutation: mut_type: SNP: ref_seq: T: mut_seq: A: mut_aa: p.K1005N: mutation info
source: CCLE: ref_target(-10 +10): ATGGATGAGCTTTTATTTCAT (SEQ ID NO: 573):
mut_target(-10 +10): ATGGATGAGCATTTATTTCAT (SEQ ID NO: 574): [Model Cell line
information]: cell: NCIH1573: cancer_type: LUNG: PAM_dist: 15: indel length: 0: CRISPR
gRNA ID: GF-CCELg12-173: [crRNA sequence]: crRNA sequence:
TTTTAAAAAATGGATGAGCATTTATTTC (SEQ ID NO: 575): LbgRNA:
AATTCTAATACGACTCACTATAGgtaatttctactaagtgtagat AAAAAATGGATGAGCATTTATTTC
(SEQ ID NO: 576): [Target gene information]: Gene ID: 9113: Symbol: LATS1:
Ensembl_Transcript_ID: ENST00000543571.1: GRCh: 37: Chr: 6: [Target cancer mutation
information]: mut_start: 149983243: mut_end: 149983243: mut_class: Missense_Mutation:
mut_type: SNP: ref_seq: T: mut_seq: A: mut_aa: p.K1005N: mutation info source: CCLE:
ref_target(-10 +10): ATGGATGAGCTTTTATTTCAT (SEQ ID NO: 573): mut_target(-10 +10):
ATGGATGAGCATTTATTTCAT (SEQ ID NO: 574): [Model Cell line information]: cell:

TABLE 6-continued

Illustrative guide RNA sequences for Cas12 comprising poylpeptide

NCIH1573: cancer_type: LUNG: PAM_dist: 16: indel length: 0: CRISPR gRNA ID: GF-
CCELg12-174: [crRNA sequence]: crRNA sequence: TTTAAAAAATGGATGAGCTTATATTTCA
(SEQ ID NO: 577): LbgRNA: AATTCTAATACGACTCACTATAGgtaatttctactaagtgtagat
AAAAATGGATGAGCTTATATTTCA (SEQ ID NO: 578): [Target gene information]: Gene ID:
9113: Symbol: LATS1: Ensembl_Transcript_ID: ENST00000543571.1: GRCh: 37: Chr: 6:
[Target cancer mutation information]: mut_start: 149983245: mut_end: 149983245: mut_class:
Nonsense_Mutation: mut_type: SNP: ref_seq: T: mut_seq: A: mut_aa: p.K1005*: mutation info
source: CCLE: ref_target(-10 +10): GGATGAGCTTTTTATTTCATCA (SEQ ID NO: 579):
mut_target(-10 +10): GGATGAGCTTATATTTCATCA (SEQ ID NO: 580) [Model Cell line
information]: cell: NCIH1573: cancer_type: LUNG: PAM_dist: 17: indel length: 0: CRISPR
gRNA ID: GF-CCELg12-175: [crRNA sequence]: crRNA sequence:
TTTTAAAAAATGGATGAGCTTATATTTC (SEQ ID NO: 581): LbgRNA:
AATTCTAATACGACTCACTATAGgtaatttctactaagtgtagat AAAAAATGGATGAGCTTATATTTC
(SEQ ID NO: 582): [Target gene information]: Gene ID: 9113: Symbol: LATS1:
Ensembl_Transcript_ID: ENST00000543571.1: GRCh: 37: Chr: 6: [Target cancer mutation
information]: mut_start: 149983245: mut_end: 149983245: mut_class: Nonsense_Mutation:
mut_type: SNP: ref_seq: T: mut_seq: A: mut_aa: p.K1005*: mutation info source: CCLE:
ref_target(-10 +10): GGATGAGCTTTTTATTTCATCA (SEQ ID NO: 579): mut_target(-10 +10):
GGATGAGCTTATATTTCATCA (SEQ ID NO: 580): [Model Cell line information]: cell:
NCIH1573: cancer_type: LUNG: PAM_dist: 18: indel length: 0: CRISPR gRNA ID: GF-
CCELg12-176: [crRNA sequence]: crRNA sequence:
TTTGGTTCTGCGGGTAGCCCCTGAACCG (SEQ ID NO: 583): LbgRNA:
AATTCTAATACGACTCACTATAGgtaatttctactaagtgtagat GTTCTGCGGGTAGCCCCTGAACCG
(SEQ ID NO: 584): [Target gene information]: Gene ID: 26524: Symbol: LATS2:
Ensembl_Transcript_ID: ENST00000382592.4: GRCh: 37: Chr: 13: [Target cancer mutation
information]: mut_start: 21620047: mut_end: 21620047: mut_class: Missense_Mutation:
mut_type: SNP: ref_seq: C: mut_seq: T: mut_aa: p.G40E: mutation info source: CCLE:
ref_target(-10 +10): ACTGTTTGGTCCTGCGGGTAG (SEQ ID NO: 585): mut_target(-10 +10):
ACTGTTTGGTTCTGCGGGTAG (SEQ ID NO: 586): [Model Cell line information]: cell:
NCIH2126: cancer_type: LUNG: PAM_dist: 3: indel length: 0: CRISPR gRNA ID: GF-
CCELg12-177: [crRNA sequence]: crRNA sequence:
TTTCTTACCCCGAAGCAGAAGGTGGGAG (SEQ ID NO: 587): LbgRNA:
AATTCTAATACGACTCACTATAGgtaatttctactaagtgtagat TTACCCCGAAGCAGAAGGTGGGAG
(SEQ ID NO: 588): [Target gene information]: Gene ID: 5604: Symbol: MAP2K1:
Ensembl_Transcript_ID: ENST00000307102.5: GRCh: 37: Chr: 15: [Target cancer mutation
information]: mut_start: 66727451: mut_end: 66727451: mut_class: Missense_Mutation:
mut_type: SNP: ref_seq: A: mut_seq: C: mut_aa: p.Q56P: mutation info source: CCLE:
ref_target(-10 +10): TTTCTTACCCAGAAGCAGAAG (SEQ ID NO: 589): mut_target(-10 +10):
TTTCTTACCCCGAAGCAGAAG (SEQ ID NO: 590): [Model Cell line information]: cell:
NCIH1437: cancer_type: LUNG: PAM_dist: 7: indel length: 0: CRISPR gRNA ID: GF-
CCELg12-178: [crRNA sequence]: crRNA sequence:
TTTAGAAATCAGTCCCCATAATGTGGAT (SEQ ID NO: 591): LbgRNA:
AATTCTAATACGACTCACTATAGgtaatttctactaagtgtagat GAAATCAGTCCCCATAATGTGGAT
(SEQ ID NO: 592): [Target gene information]: Gene ID: 4292: Symbol: MLH1:
Ensembl_Transcript_ID: ENST00000231790.2: GRCh: 37: Chr: 3: [Target cancer mutation
information]: mut_start: 37061819: mut_end: 37061819: mut_class: Missense_Mutation:
mut_type: SNP: ref_seq: G: mut_seq: T: mut_aa: p.Q301H: mutation info source: CCLE:
ref_target(-10 +10): TCAGTCCCCAGAATGTGGATG (SEQ ID NO: 593): mut_target(-10 +10):
TCAGTCCCCATAATGTGGATG (SEQ ID NO: 594): [Model Cell line information]: cell:
NCIH1573: cancer_type: LUNG: PAM_dist: 15: indel length: 0: CRISPR gRNA ID: GF-
CCELg12-179: [crRNA sequence]: crRNA sequence: TTTGTAAGACAGTTTTATTTTACTGTTT
(SEQ ID NO: 595): LbgRNA: AATTCTAATACGACTCACTATAGgtaatttctactaagtgtagat
TAAGACAGTTTTATTTTACTGTTT (SEQ ID NO: 596): [Target gene information]: Gene ID:
4361: Symbol: MRE11A: Ensembl_Transcript_ID: ENST00000323929.3: GRCh: 37: Chr: 11:
[Target cancer mutation information]: mut_start: 94211901: mut_end: 94211902: mut_class:
Splice_Site: mut_type: DNP: ref_seq: CT: mut_seq: AA: mut_aa: p.181 182LG>F*: mutation
info source: CCLE: ref_target(-10 +10): ACTGTCTTACCTAAACCATATA (SEQ ID NO: 597):
mut_target(-10 +10): ACTGTCTTACAAAAACCATATA (SEQ ID NO: 598): [Model Cell line
information]: cell: NCIH1573: cancer_type: LUNG: PAM_dist: -2: indel length: 0: CRISPR
gRNA ID: GF-CCELg12-180: [crRNA sequence]: crRNA sequence:
TTTTTGTAAGACAGTTTTATTTTACTGT (SEQ ID NO: 599): LbgRNA:
AATTCTAATACGACTCACTATAGgtaatttctactaagtgtagat TGTAAGACAGTTTTATTTTACTGT
(SEQ ID NO: 600): [Target gene information]: Gene ID: 4361: Symbol: MRE11A:
Ensembl_Transcript_ID: ENST00000323929.3: GRCh: 37: Chr: 11: [Target cancer mutation
information]: mut_start: 94211901: mut_end: 94211902: mut_class: Splice_Site: mut_type: DNP:
ref_seq: CT: mut_seq: AA: mut_aa: p.181 182LG>F*: mutation info source: CCLE: ref_target(-10
+10): ACTGTCTTACCTAAACCATATA (SEQ ID NO: 597): mut_target(-10 +10):
ACTGTCTTACAAAAACCATATA (SEQ ID NO: 598): [Model Cell line information]: cell:
NCIH1573: cancer_type: LUNG: PAM_dist: 0: indel length: 0: CRISPR gRNA ID: GF-
CCELg12-181: [crRNA sequence]: crRNA sequence: TTTTGTAAGACAGTTTTATTTTACTGTT
(SEQ ID NO: 601): LbgRNA: AATTCTAATACGACTCACTATAGgtaatttctactaagtgtagat
GTAAGACAGTTTTATTTTACTGTT (SEQ ID NO: 602): [Target gene information]: Gene ID:
4361: Symbol: MRE11A: Ensembl_Transcript_ID: ENST00000323929.3: GRCh: 37: Chr: 11:
[Target cancer mutation information]: mut_start: 94211901: mut_end: 94211902: mut_class:
Splice_Site: mut_type: DNP: ref_seq: CT: mut_seq: AA: mut_aa: p.181 182LG>F*: mutation
info source: CCLE: ref_target(-10 +10): ACTGTCTTACCTAAACCATATA (SEQ ID NO: 597):
mut_target(-10 +10): ACTGTCTTACAAAAACCATATA (SEQ ID NO: 598): [Model Cell line
information]: cell: NCIH1573: cancer_type: LUNG: PAM_dist: -1: indel length: 0: CRISPR TABLE 6-continued Illustrative guide RNA sequences for Cas12 comprising poylpeptide gRNA ID: GF-CCELg12-182: [crRNA sequence]: crRNA sequence:
TTTGGCCTGGTGATCTCACAGCCCACCC (SEQ ID NO: 603): LbgRNA:
AATTCTAATACGACTCACTATAGgtaatttctactaagtgtagat GCCTGGTGATCTCACAGCCCACCC
(SEQ ID NO: 604): [Target gene information]: Gene ID: 4595: Symbol: MUTYH:
Ensembl_Transcript_ID: ENST00000372098.3: GRCh: 37: Chr: 1: [Target cancer mutation
information]: mut_start: 45798247: mut_end: 45798247: mut_class: Splice_Site: mut_type: SNP:
ref_seq: T: mut_seq: A: mut_aa: p.Q227L: mutation info source: CCLE: ref_target(-10 +10):
TGAGATCACCTGGCCAAAGGC (SEQ ID NO: 605): mut_target(-10 +10):
TGAGATCACCAGGCCAAAGGC (SEQ ID NO: 606): [Model Cell line information]: cell:
NCIH1573: cancer_type: LUNG: PAM_dist: 4: indel length: 0: CRISPR gRNA ID: GF-
CCELg12-183: [crRNA sequence]: crRNA sequence: TTTCTTTCCTGCTGTCCTGACAGATCAA
(SEQ ID NO: 607): LbgRNA: AATTCTAATACGACTCACTATAGgtaatttctactaagtgtagat
TTTCCTGCTGTCCTGACAGATCAA (SEQ ID NO: 608): [Target gene information]: Gene ID:
4683: Symbol: NBN: Ensembl_Transcript_ID: ENST00000265433.3: GRCh: 37: Chr: 8: [Target
cancer mutation information]: mut_start: 90983459: mut_end: 90983459: mut_class:
Missense_Mutation: mut_type: SNP: ref_seq: C: mut_seq: T: mut_aa: p.R215Q: mutation info
source: CCLE: ref_target(-10 +10): TCTTTCCTGCCGTCCTGACAG (SEQ ID NO: 609):
mut_target(-10 +10): TCTTTCCTGCTGTCCTGACAG (SEQ ID NO: 610): [Model Cell line
information]: cell: NCIH1437: cancer_type: LUNG: PAM_dist: 9: indel length: 0: CRISPR
gRNA ID: GF-CCELg12-184: [crRNA sequence]: crRNA sequence:
TTTCCTGCTGTCCTGACAGATCAACATT (SEQ ID NO: 611): LbgRNA:
AATTCTAATACGACTCACTATAGgtaatttctactaagtgtagat CTGCTGTCCTGACAGATCAACATT
(SEQ ID NO: 612): [Target gene information]: Gene ID: 4683: Symbol: NBN:
Ensembl_Transcript_ID: ENST00000265433.3: GRCh: 37: Chr: 8: [Target cancer mutation
information]: mut_start: 90983459: mut_end: 90983459: mut_class: Missense_Mutation:
mut_type: SNP: ref_seq: C: mut_seq: T: mut_aa: p.R215Q: mutation info source: CCLE:
ref_target(-10 +10): TCTTTCCTGCCGTCCTGACAG (SEQ ID NO: 609): mut_target(-10 +10):
TCTTTCCTGCTGTCCTGACAG (SEQ ID NO: 610): [Model Cell line information]: cell:
NCIH1437: cancer_type: LUNG: PAM_dist: 5: indel length: 0: CRISPR gRNA ID: GF-
CCELg12-185: [crRNA sequence]: crRNA sequence: TTTGAAGATTTGTTTTCTTTCCTGCTGT
(SEQ ID NO: 613): LbgRNA: AATTCTAATACGACTCACTATAGgtaatttctactaagtgtagat
AAGATTTGTTTTCTTTCCTGCTGT (SEQ ID NO: 614): [Target gene information]: Gene ID:
4683: Symbol: NBN: Ensembl_Transcript_ID: ENST00000265433.3: GRCh: 37: Chr: 8: [Target
cancer mutation information]: mut_start: 90983459: mut_end: 90983459: mut_class:
Missense_Mutation: mut_type: SNP: ref_seq: C: mut_seq: T: mut_aa: p.R215Q: mutation info
source: CCLE: ref_target(-10 +10): TCTTTCCTGCCGTCCTGACAG (SEQ ID NO: 609):
mut_target(-10 +10): TCTTTCCTGCTGTCCTGACAG (SEQ ID NO: 610): [Model Cell line
information]: cell: NCIH1437: cancer_type: LUNG: PAM_dist: 22: indel length: 0: CRISPR
gRNA ID: GF-CCELg12-186: [crRNA sequence]: crRNA sequence:
TTTGTTTTCTTTCCTGCTGTCCTGACAG (SEQ ID NO: 615): LbgRNA:
AATTCTAATACGACTCACTATAGgtaatttctactaagtgtagat TTTTCTTTCCTGCTGTCCTGACAG
(SEQ ID NO: 616): [Target gene information]: Gene ID: 4683: Symbol: NBN:
Ensembl_Transcript_ID: ENST00000265433.3: GRCh: 37: Chr: 8: [Target cancer mutation
information]: mut_start: 90983459: mut_end: 90983459: mut_class: Missense_Mutation:
mut_type: SNP: ref_seq: C: mut_seq: T: mut_aa: p.R215Q: mutation info source: CCLE:
ref_target(-10 +10): TCTTTCCTGCCGTCCTGACAG (SEQ ID NO: 609): mut_target(-10 +10):
TCTTTCCTGCTGTCCTGACAG (SEQ ID NO: 610): [Model Cell line information]: cell:
NCIH1437: cancer_type: LUNG: PAM_dist: 14: indel length: 0: CRISPR gRNA ID: GF-
CCELg12-187: [crRNA sequence]: crRNA sequence: TTTTCTTTCCTGCTGTCCTGACAGATCA
(SEQ ID NO: 617): LbgRNA: AATTCTAATACGACTCACTATAGgtaatttctactaagtgtagat
CTTTCCTGCTGTCCTGACAGATCA (SEQ ID NO: 618): [Target gene information]: Gene ID:
4683: Symbol: NBN: Ensembl_Transcript_ID: ENST00000265433.3: GRCh: 37: Chr: 8: [Target
cancer mutation information]: mut_start: 90983459: mut_end: 90983459: mut_class:
Missense_Mutation: mut_type: SNP: ref_seq: C: mut_seq: T: mut_aa: p.R215Q: mutation info
source: CCLE: ref_target(-10 +10): TCTTTCCTGCCGTCCTGACAG (SEQ ID NO: 609):
mut_target(-10 +10): TCTTTCCTGCTGTCCTGACAG (SEQ ID NO: 610): [Model Cell line
information]: cell: NCIH1437: cancer_type: LUNG: PAM_dist: 10: indel length: 0: CRISPR
gRNA ID: GF-CCELg12-188: [crRNA sequence]: crRNA sequence:
TTTCGCTTTGAAGATTTGTTTTCTTTCC (SEQ ID NO: 619): LbgRNA:
AATTCTAATACGACTCACTATAGgtaatttctactaagtgtagat GCTTTGAAGATTTGTTTTCTTTCC
(SEQ ID NO: 620): [Target gene information]: Gene ID: 4683: Symbol: NBN:
Ensembl_Transcript_ID: ENST00000265433.3: GRCh: 37: Chr: 8: [Target cancer mutation
information]: mut_start: 90983432: mut_end: 90983432: mut_class: Missense_Mutation:
mut_type: SNP: ref_seq: C: mut_seq: G: mut_aa: p.G224A: mutation info source: CCLE:
ref_target(-10 +10): AAATGTTTTCCCTTTGAAGAT (SEQ ID NO: 621): mut_target(-10 +10):
AAATGTTTTCGCTTTGAAGAT (SEQ ID NO: 622): [Model Cell line information]: cell:
NCIH460: cancer_type: LUNG: PAM_dist: 1: indel length: 0: CRISPR gRNA ID: GF-CCELg12-
189: [crRNA sequence]: crRNA sequence: TTTTCGCTTTGAAGATTGTTTTCTTTC (SEQ ID
NO: 623): LbgRNA: AATTCTAATACGACTCACTATAGgtaatttctactaagtgtagat
CGCTTTGAAGATTTGTTTTCTTTC (SEQ ID NO: 624): [Target gene information]: Gene ID:
4683: Symbol: NBN: Ensembl_Transcript_ID: ENST00000265433.3: GRCh: 37: Chr: 8: [Target
cancer mutation information]: mut_start: 90983432: mut_end: 90983432: mut_class:
Missense_Mutation: mut_type: SNP: ref_seq: C: mut_seq: G: mut_aa: p.G224A: mutation info
source: CCLE: ref_target(-10 +10): AAATGTTTTCCCTTTGAAGAT (SEQ ID NO: 621):
mut_target(-10 +10): AAATGTTTTCGCTTTGAAGAT (SEQ ID NO: 622): [Model Cell line
information]: cell: NCIH460: cancer_type: LUNG: PAM_dist: 2: indel length: 0: CRISPR gRNA
ID: GF-CCELg12-190: [crRNA sequence]: crRNA sequence:
TTTCCGTGGTGGGCTCAAGCTCAACAGC (SEQ ID NO: 625): LbgRNA:

TABLE 6-continued

Illustrative guide RNA sequences for Cas12 comprising poylpeptide

AATTCTAATACGACTCACTATAGgtaatttctactaagtgtagat CGTGGTGGGCTCAAGCTCAACAGC
(SEQ ID NO: 626): [Target gene information]: Gene ID: 9611: Symbol: NCOR1:
Ensembl_Transcript_ID: ENST00000268712.3: GRCh: 37: Chr: 17: [Target cancer mutation
information]: mut_start: 16005004: mut_end: 16005004: mut_class: Silent: mut_type: SNP:
ref_seq: C: mut_seq: A: mut_aa: p.A750A: mutation info source: CCLE: ref_target(-10 +10):
CAAGCTCAACCGCAGGTTCTG (SEQ ID NO: 627): mut_target(-10 +10):
CAAGCTCAACAGCAGGTTCTG (SEQ ID NO: 628): [Model Cell line information]: cell:
NCIH1573: cancer_type: LUNG: PAM_dist: 22: indel length: 0: CRISPR gRNA ID: GF-
CCELg12-191: [crRNA sequence]: crRNA sequence: TTTCGAGGAAATACCCCCTTACACCTTG
(SEQ ID NO: 629): LbgRNA: AATTCTAATACGACTCACTATAGgtaatttctactaagtgtagat
GAGGAAATACCCCCTTACACCTTG (SEQ ID NO: 630): [Target gene information]: Gene ID:
4792: Symbol: NFKBIA: Ensembl_Transcript_ID: ENST00000216797.5: GRCh: 37: Chr: 14:
[Target cancer mutation information]: mut_start: 35872461: mut_end: 35872461: mut_class: Silent:
mut_type: SNP: ref_seq: G: mut_seq: A: mut_aa: p.L148L: mutation info source: CCLE:
ref_target(-10 +10): GCAAGGTGTAGGGGGGTATTT (SEQ ID NO: 631): mut_target(-10 +10):
GCAAGGTGTAAGGGGGTATTT (SEQ ID NO: 632): [Model Cell line information]: cell:
CFPAC1: cancer_type: PANCREAS: PAM_dist: 15: indel length: 0: CRISPR gRNA ID: GF-
CCELg12-192: [crRNA sequence]: crRNA sequence:
TTTGACGGTCAGAATTGTGAAGTGAACG (SEQ ID NO: 633): LbgRNA:
AATTCTAATACGACTCACTATAGgtaatttctactaagtgtagat ACGGTCAGAATTGTGAAGTGAACG
(SEQ ID NO: 634): [Target gene information]: Gene ID: 4854: Symbol: NOTCH3:
Ensembl_Transcript_ID: ENST00000263388.2: GRCh: 37: Chr: 19: [Target cancer mutation
information]: mut_start: 15302671: mut_end: 15302671: mut_class: Missense_Mutation:
mut_type: SNP: ref_seq: C: mut_seq: G: mut_aa: p.E229D: mutation info source: CCLE:
ref_target(-10 +10): AATTCTGACCCTCAAACCCTA (SEQ ID NO: 635): mut_target(-10 +10):
AATTCTGACCGTCAAACCCTA (SEQ ID NO: 636): [Model Cell line information]: cell:
NCIH460: cancer_type: LUNG: PAM_dist: 2: indel length: 0: CRISPR gRNA ID: GF-CCELg12-
193: [crRNA sequence]: crRNA sequence: TTTCCAGCTGTATCCAGTATGTCCAACA (SEQ ID
NO: 637): LbgRNA: AATTCTAATACGACTCACTATAGgtaatttctactaagtgtagat
CAGCTGTATCCAGTATGTCCAACA (SEQ ID NO: 638): [Target gene information]: Gene ID:
4893: Symbol: NRAS: Ensembl_Transcript_ID: ENST00000369535.4: GRCh: 37: Chr: 1:
[Target cancer mutation information]: mut_start: 115256530: mut_end: 115256530: mut_class:
Missense_Mutation: mut_type: SNP: ref_seq: G: mut_seq: T: mut_aa: p.Q61K: mutation info
source: CCLE: ref_target(-10 +10): TACTCTTCTTGTCCAGCTGTA (SEQ ID NO: 639):
mut_target(-10 +10): TACTCTTCTTTTCCAGCTGTA (SEQ ID NO: 640): [Model Cell line
information]: cell: NCIH1299: cancer_type: LUNG: PAM_dist: -2: indel length: 0: CRISPR
gRNA ID: GF-CCELg12-194: [crRNA sequence]: crRNA sequence:
TTTTCCAGCTGTATCCAGTATGTCCAAC (SEQ ID NO: 641): LbgRNA:
AATTCTAATACGACTCACTATAGgtaatttctactaagtgtagat CCAGCTGTATCCAGTATGTCCAAC
(SEQ ID NO: 642): [Target gene information]: Gene ID: 4893: Symbol: NRAS:
Ensembl_Transcript_ID: ENST00000369535.4: GRCh: 37: Chr: 1: [Target cancer mutation
information]: mut_start: 115256530: mut_end: 115256530: mut_class: Missense_Mutation:
mut_type: SNP: ref_seq: G: mut_seq: T: mut_aa: p.Q61K: mutation info source: CCLE:
ref_target(-10 +10): TACTCTTCTTGTCCAGCTGTA (SEQ ID NO: 639): mut_target(-10 +10):
TACTCTTCTTTTCCAGCTGTA (SEQ ID NO: 640): [Model Cell line information]: cell:
NCIH1299: cancer_type: LUNG: PAM_dist: -1: indel length: 0: CRISPR gRNA ID: GF-
CCELg12-195: [crRNA sequence]: crRNA sequence: TTTCCAGCTGTATCCAGTATGTCCAACA
(SEQ ID NO: 637): LbgRNA: AATTCTAATACGACTCACTATAGgtaatttctactaagtgtagat
CAGCTGTATCCAGTATGTCCAACA (SEQ ID NO: 638): [Target gene information]: Gene ID:
4893: Symbol: NRAS: Ensembl_Transcript_ID: ENST00000369535.4: GRCh: 37: Chr: 1:
[Target cancer mutation information]: mut_start: 115256530: mut_end: 115256530: mut_class:
Missense_Mutation: mut_type: SNP: ref_seq: G: mut_seq: T: mut_aa: p.Q61K: mutation info
source: CCLE: ref_target(-10 +10): TACTCTTCTTGTCCAGCTGTA (SEQ ID NO: 639):
mut_target(-10 +10): TACTCTTCTTTTCCAGCTGTA (SEQ ID NO: 640): [Model Cell line
information]: cell: NCIH1573: cancer_type: LUNG: PAM_dist: -2: indel length: 0: CRISPR
gRNA ID: GF-CCELg12-196: [crRNA sequence]: crRNA sequence:
TTTTCCAGCTGTATCCAGTATGTCCAAC (SEQ ID NO: 641): LbgRNA:
AATTCTAATACGACTCACTATAGgtaatttctactaagtgtagat CCAGCTGTATCCAGTATGTCCAAC
(SEQ ID NO: 642): [Target gene information]: Gene ID: 4893: Symbol: NRAS:
Ensembl_Transcript_ID: ENST00000369535.4: GRCh: 37: Chr: 1: [Target cancer mutation
information]: mut_start: 115256530: mut_end: 115256530: mut_class: Missense_Mutation:
mut_type: SNP: ref_seq: G: mut_seq: T: mut_aa: p.Q61K: mutation info source: CCLE:
ref_target(-10 +10): TACTCTTCTTGTCCAGCTGTA (SEQ ID NO: 639): mut_target(-10 +10):
TACTCTTCTTTTCCAGCTGTA (SEQ ID NO: 640): [Model Cell line information]: cell:
NCIH1573: cancer_type: LUNG: PAM_dist: -1: indel length: 0: CRISPR gRNA ID: GF-
CCELg12-197: [crRNA sequence]: crRNA sequence: TTTGCTTTTCCTCATCACCTGCTCCAAT
(SEQ ID NO: 643): LbgRNA: AATTCTAATACGACTCACTATAGgtaatttctactaagtgtagat
CTTTTCCTCATCACCTGCTCCAAT (SEQ ID NO: 644): [Target gene information]: Gene ID:
64324: Symbol: NSD1: Ensembl_Transcript_ID: ENST00000439151.2: GRCh: 37: Chr: 5:
[Target cancer mutation information]: mut_start: 176637295: mut_end: 176637295: mut_class:
Missense_Mutation: mut_type: SNP: ref_seq: G: mut_seq: A: mut_aa: p.R632Q: mutation info
source: CCLE: ref_target(-10 +10): GAGGAAAAGCGAAGTGATTCC (SEQ ID NO: 645):
mut_target(-10 +10): GAGGAAAAGCAAAGTGATTCC (SEQ ID NO: 646): [Model Cell line
information]: cell: NCIH1975: cancer_type: LUNG: PAM_dist: -1: indel length: 0: CRISPR
gRNA ID: GF-CCELg12-198: [crRNA sequence]: crRNA sequence:
TTTGGGGTTGCCTTGCACAGTGAATGGA (SEQ ID NO: 647): LbgRNA:
AATTCTAATACGACTCACTATAGgtaatttctactaagtgtagat GGGTTGCCTTGCACAGTGAATGGA
(SEQ ID NO: 648): [Target gene information]: Gene ID: 4915: Symbol: NTRK2:

TABLE 6-continued

Illustrative guide RNA sequences for Cas12 comprising poylpeptide

Ensembl_Transcript_ID: ENST00000323115.4: GRCh: 37: Chr: 9: [Target cancer mutation
information]: mut_start: 87342637: mut_end: 87342637: mut_class: Missense_Mutation:
mut_type: SNP: ref_seq: A: mut_seq: C: mut_aa: p.K308Q: mutation info source: CCLE:
ref_target(-10 +10): ATTCACTGTG<u>A</u>AAGGCAACCC (SEQ ID NO: 649): mut_target(-10 +10):
ATTCACTGTG<u>C</u>AAGGCAACCC (SEQ ID NO: 650): [Model Cell line information]: cell:
NCIH661: cancer_type: LUNG: PAM_dist: 11: indel length: 0: CRISPR gRNA ID: GF-
CCELg12-199: [crRNA sequence]: crRNA sequence: TTT<u>T</u>CCTTGTGCCTCCAAACTTACAGGTG
(SEQ ID NO: 651): LbgRNA: AATTCTAATACGACTCACTATAGgtaatttctactaagtgtagat
CTTGTGCCTCCAAACTTACAGGTG (SEQ ID NO: 652): [Target gene information]: Gene ID:
79728: Symbol: PALB2: Ensembl_Transcript_ID: ENST00000261584.4: GRCh: 37: Chr: 16:
[Target cancer mutation information]: mut_start: 23646988: mut_end: 23646988: mut_class: Silent:
mut_type: SNP: ref_seq: G: mut_seq: T: mut_aa: p.G293G: mutation info source: CCLE:
ref_target(-10 +10): TCATTTTTTT<u>G</u>CCTTGTGCCT (SEQ ID NO: 653): mut_target(-10 +10):
TCATTTTTTT<u>T</u>CCTTGTGCCT (SEQ ID NO: 654): [Model Cell line information]: cell:
HCC827GR5: cancer_type: LUNG: PAM_dist: -1: indel length: 0: CRISPR gRNA ID: GF-
CCELg12-200: [crRNA sequence]: crRNA sequence: TTTTTTT<u>T</u>CCTTGTGCCTCCAAACTTAC
(SEQ ID NO: 655): LbgRNA: AATTCTAATACGACTCACTATAGgtaatttctactaagtgtagat
TTTTCCTTGTGCCTCCAAACTTAC (SEQ ID NO: 656): [Target gene information]: Gene ID:
79728: Symbol: PALB2: Ensembl_Transcript_ID: ENST00000261584.4: GRCh: 37: Chr: 16:
[Target cancer mutation information]: mut_start: 23646988: mut_end: 23646988: mut_class: Silent:
mut_type: SNP: ref_seq: G: mut_seq: T: mut_aa: p.G293G: mutation info source: CCLE:
ref_target(-10 +10): TCATTTTTTT<u>G</u>CCTTGTGCCT (SEQ ID NO: 653): mut_target(-10 +10):
TCATTTTTTT<u>T</u>CCTTGTGCCT (SEQ ID NO: 654): [Model Cell line information]: cell:
HCC827GR5: cancer_type: LUNG: PAM_dist: 4: indel length: 0: CRISPR gRNA ID: GF-
CCELg12-201: [crRNA sequence]: crRNA sequence: TTTTTT<u>T</u>CCTTGTGCCTCCAAACTTACA
(SEQ ID NO: 657): LbgRNA: AATTCTAATACGACTCACTATAGgtaatttctactaagtgtagat
TTTCCTTGTGCCTCCAAACTTACA (SEQ ID NO: 658): [Target gene information]: Gene ID:
79728: Symbol: PALB2: Ensembl_Transcript_ID: ENST00000261584.4: GRCh: 37: Chr: 16:
[Target cancer mutation information]: mut_start: 23646988: mut_end: 23646988: mut_class: Silent:
mut_type: SNP: ref_seq: G: mut_seq: T: mut_aa: p.G293G: mutation info source: CCLE:
ref_target(-10 +10): TCATTTTTTT<u>G</u>CCTTGTGCCT (SEQ ID NO: 653): mut_target(-10 +10):
TCATTTTTTT<u>T</u>CCTTGTGCCT (SEQ ID NO: 654): [Model Cell line information]: cell:
HCC827GR5: cancer_type: LUNG: PAM_dist: 3: indel length: 0: CRISPR gRNA ID: GF-
CCELg12-202: [crRNA sequence]: crRNA sequence: TTTTT<u>T</u>CCTTGTGCCTCCAAACTTACAG
(SEQ ID NO: 659): LbgRNA: AATTCTAATACGACTCACTATAGgtaatttctactaagtgtagat
TTCCTTGTGCCTCCAAACTTACAG (SEQ ID NO: 660): [Target gene information]: Gene ID:
79728: Symbol: PALB2: Ensembl_Transcript_ID: ENST00000261584.4: GRCh: 37: Chr: 16:
[Target cancer mutation information]: mut_start: 23646988: mut_end: 23646988: mut_class: Silent:
mut_type: SNP: ref_seq: G: mut_seq: T: mut_aa: p.G293G: mutation info source: CCLE:
ref_target(-10 +10): TCATTTTTTT<u>G</u>CCTTGTGCCT (SEQ ID NO: 653): mut_target(-10 +10):
TCATTTTTTT<u>T</u>CCTTGTGCCT (SEQ ID NO: 654): [Model Cell line information]: cell:
HCC827GR5: cancer_type: LUNG: PAM_dist: 2: indel length: 0: CRISPR gRNA ID: GF-
CCELg12-203: [crRNA sequence]: crRNA sequence: TTTT<u>T</u>CCTTGTGCCTCCAAACTTACAGG
(SEQ ID NO: 661): LbgRNA: AATTCTAATACGACTCACTATAGgtaatttctactaagtgtagat
TCCTTGTGCCTCCAAACTTACAGG (SEQ ID NO: 662): [Target gene information]: Gene ID:
79728: Symbol: PALB2: Ensembl_Transcript_ID: ENST00000261584.4: GRCh: 37: Chr: 16:
[Target cancer mutation information]: mut_start: 23646988: mut_end: 23646988: mut_class: Silent:
mut_type: SNP: ref_seq: G: mut_seq: T: mut_aa: p.G293G: mutation info source: CCLE:
ref_target(-10 +10): TCATTTTTTT<u>G</u>CCTTGTGCCT (SEQ ID NO: 653): mut_target(-10 +10):
TCATTTTTTT<u>T</u>CCTTGTGCCT (SEQ ID NO: 654): [Model Cell line information]: cell:
HCC827GR5: cancer_type: LUNG: PAM_dist: 1: indel length: 0: CRISPR gRNA ID: GF-
CCELg12-204: [crRNA sequence]: crRNA sequence: TTT<u>T</u>CCTTGTGCCTCCAAACTTACAGGT
(SEQ ID NO: 663): LbgRNA: AATTCTAATACGACTCACTATAGgtaatttctactaagtgtagat
CCTTGTGCCTCCAAACTTACAGGT (SEQ ID NO: 664): [Target gene information]: Gene ID:
79728: Symbol: PALB2: Ensembl_Transcript_ID: ENST00000261584.4: GRCh: 37: Chr: 16:
[Target cancer mutation information]: mut_start: 23646988: mut_end: 23646988: mut_class: Silent:
mut_type: SNP: ref_seq: G: mut_seq: T: mut_aa: p.G293G: mutation info source: CCLE:
ref_target(-10 +10): TCATTTTTTT<u>G</u>CCTTGTGCCT (SEQ ID NO: 653): mut_target(-10 +10):
TCATTTTTTT<u>T</u>CCTTGTGCCT (SEQ ID NO: 654): [Model Cell line information]: cell:
HCC827GR5: cancer_type: LUNG: PAM_dist: 0: indel length: 0: CRISPR gRNA ID: GF-
CCELg12-205: [crRNA sequence]: crRNA sequence:
TTTGGAGGCACAAGG<u>A</u>AAAAAAATGACT (SEQ ID NO: 665): LbgRNA:
AATTCTAATACGACTCACTATAGgtaatttctactaagtgtagat GAGGCACAAGGAAAAAAATGACT
(SEQ ID NO: 666): [Target gene information]: Gene ID: 79728: Symbol: PALB2:
Ensembl_Transcript_ID: ENST00000261584.4: GRCh: 37: Chr: 16: [Target cancer mutation
information]: mut_start: 23646988: mut_end: 23646988: mut_class: Silent: mut_type: SNP:
ref_seq: G: mut_seq: T: mut_aa: p.G293G: mutation info source: CCLE: ref_target(-10 +10):
TCATTTTTTT<u>G</u>CCTTGTGCCT (SEQ ID NO: 653): mut_target(-10 +10):
TCATTTTTTT<u>T</u>CCTTGTGCCT (SEQ ID NO: 654): [Model Cell line information]: cell:
HCC827GR5: cancer_type: LUNG: PAM_dist: 12: indel length: 0: CRISPR gRNA ID: GF-
CCELg12-206: [crRNA sequence]: crRNA sequence: TTTCTTAAACCTACCTCATTCGAA<u>T</u>ACT
(SEQ ID NO: 667): LbgRNA: AATTCTAATACGACTCACTATAGgtaatttctactaagtgtagat
TTAAACCTACCTCATTCGAATACT (SEQ ID NO: 668): [Target gene information]: Gene ID:
55193: Symbol: PBRM1: Ensembl_Transcript_ID: ENST00000296302.7: GRCh: 37: Chr: 3:
[Target cancer mutation information]: mut_start: 52678730: mut_end: 52678730: mut_class:
Missense_Mutation: mut_type: SNP: ref_seq: G: mut_seq: T: mut_aa: p.L297I: mutation info
source: CCLE: ref_target(-10 +10): CTCATTCGAA<u>G</u>ACTTGACTTA (SEQ ID NO: 669):
mut_target(-10 +10): CTCATTCGAA<u>T</u>ACTTGACTTA (SEQ ID NO: 670): [Model Cell line TABLE 6-continued Illustrative guide RNA sequences for Cas12 comprising poylpeptide information]: cell: NCIH1975: cancer_type: LUNG: PAM_dist: 21: indel length: 0: CRISPR
gRNA ID: GF-CCELg12-207: [crRNA sequence]: crRNA sequence:
TTTTCTTAAACCTACCTCATTCGAATAC (SEQ ID NO: 671): LbgRNA:
AATTCTAATACGACTCACTATAGgtaatttctactaagtgtagat CTTAAACCTACCTCATTCGAATAC
(SEQ ID NO: 672): [Target gene information]: Gene ID: 55193: Symbol: PBRM1:
Ensembl_Transcript_ID: ENST00000296302.7: GRCh: 37: Chr: 3: [Target cancer mutation
information]: mut_start: 52678730: mut_end: 52678730: mut_class: Missense_Mutation:
mut_type: SNP: ref_seq: G: mut_seq: T: mut_aa: p.L297I: mutation info source: CCLE:
ref_target(-10 +10): CTCATTCGAAGACTTGACTTA (SEQ ID NO: 669): mut_target(-10 +10):
CTCATTCGAATACTTGACTTA (SEQ ID NO: 670): [Model Cell line information]: cell:
NCIH1975: cancer_type: LUNG: PAM_dist: 22: indel length: 0: CRISPR gRNA ID: GF-
CCELg12-208: [crRNA sequence]: crRNA sequence: TTTGTATTCTTCTCATCATCACCTTTAT
(SEQ ID NO: 673): LbgRNA: AATTCTAATACGACTCACTATAGgtaatttctactaagtgtagat
TATTCTTCTCATCATCACCTTTAT (SEQ ID NO: 674): [Target gene information]: Gene ID:
55193: Symbol: PBRM1: Ensembl_Transcript_ID: ENST00000296302.7: GRCh: 37: Chr: 3:
[Target cancer mutation information]: mut_start: 52620488: mut_end: 52620488: mut_class:
Missense_Mutation: mut_type: SNP: ref_seq: C: mut_seq: T: mut_aa: p.D1114N: mutation info
source: CCLE: ref_target(-10 +10): TCTGAGTTGTCTGTATTCTTC (SEQ ID NO: 675):
mut_target(-10 +10): TCTGAGTTGTTTGTATTCTTC (SEQ ID NO: 676): [Model Cell line
information]: cell: NCIH1563: cancer_type: LUNG: PAM_dist: -2: indel length: 0: CRISPR
gRNA ID: GF-CCELg12-209: [crRNA sequence]: crRNA sequence:
TTTATCCCTCCAAACGTTTGTGCATGAC (SEQ ID NO: 677): LbgRNA:
AATTCTAATACGACTCACTATAGgtaatttctactaagtgtagat TCCCTCCAAACGTTTGTGCATGAC
(SEQ ID NO: 678): [Target gene information]: Gene ID: 5288: Symbol: PIK3C2G:
Ensembl_Transcript_ID: ENST00000266497.5: GRCh: 37: Chr: 12: [Target cancer mutation
information]: mut_start: 18658378: mut_end: 18658378: mut_class: Silent: mut_type: SNP:
ref_seq: A: mut_seq: G: mut_aa: p.T1061T: mutation info source: CCLE: ref_target(-10 +10):
ATGCACAAACATTTGGAGGGA (SEQ ID NO: 679): mut_target(-10 +10):
ATGCACAAAGTTTGGAGGGA (SEQ ID NO: 680): [Model Cell line information]: cell:
NCIH1573: cancer_type: LUNG: PAM_dist: 11: indel length: 0: CRISPR gRNA ID: GF-
CCELg12-210: [crRNA sequence]: crRNA sequence: TTTTTATCCCTCCAAACGTTTGTGCATG
(SEQ ID NO: 681): LbgRNA: AATTCTAATACGACTCACTATAGgtaatttctactaagtgtagat
TATCCCTCCAAACGTTTGTGCATG (SEQ ID NO: 682): [Target gene information]: Gene ID:
5288: Symbol: PIK3C2G: Ensembl_Transcript_ID: ENST00000266497.5: GRCh: 37: Chr: 12:
[Target cancer mutation information]: mut_start: 18658378: mut_end: 18658378: mut_class: Silent:
mut_type: SNP: ref_seq: A: mut_seq: G: mut_aa: p.T1061T: mutation info source: CCLE:
ref_target(-10 +10): ATGCACAAACATTTGGAGGGA (SEQ ID NO: 679): mut_target(-10 +10):
ATGCACAAAGTTTGGAGGGA (SEQ ID NO: 680): [Model Cell line information]: cell:
NCIH1573: cancer_type: LUNG: PAM_dist: 13: indel length: 0: CRISPR gRNA ID: GF-
CCELg12-211: [crRNA sequence]: crRNA sequence: TTTATCCCTCCAAACGTTTGTGCATGA
(SEQ ID NO: 683): LbgRNA: AATTCTAATACGACTCACTATAGgtaatttctactaagtgtagat
ATCCCTCCAAACGTTTGTGCATGA (SEQ ID NO: 684): [Target gene information]: Gene ID:
5288: Symbol: PIK3C2G: Ensembl_Transcript_ID: ENST00000266497.5: GRCh: 37: Chr: 12:
[Target cancer mutation information]: mut_start: 18658378: mut_end: 18658378: mut_class: Silent:
mut_type: SNP: ref_seq: A: mut_seq: G: mut_aa: p.T1061T: mutation info source: CCLE:
ref_target(-10 +10): ATGCACAAACATTTGGAGGGA (SEQ ID NO: 679): mut_target(-10 +10):
ATGCACAAAGTTTGGAGGGA (SEQ ID NO: 680): [Model Cell line information]: cell:
NCIH1573: cancer_type: LUNG: PAM_dist: 12: indel length: 0: CRISPR gRNA ID: GF-
CCELg12-212: [crRNA sequence]: crRNA sequence: TTTAAGGGTTACATTCAACAATGCTTGG
(SEQ ID NO: 685): LbgRNA: AATTCTAATACGACTCACTATAGgtaatttctactaagtgtagat
AGGGTTACATTCAACAATGCTTGG (SEQ ID NO: 686): [Target gene information]: Gene ID:
5289: Symbol: PIK3C3: Ensembl_Transcript_ID: ENST00000262039.4: GRCh: 37: Chr: 18:
[Target cancer mutation information]: mut_start: 39607512: mut_end: 39607512: mut_class:
Splice_Site: mut_type: SNP: ref_seq: G: mut_seq: T: mut_aa: p.K530N: mutation info source:
CCLE: ref_target(-10 +10): CATTGTTGAAGGTAACCCTTA (SEQ ID NO: 687): mut_target(-10
+10): CATTGTTGAATGTAACCCTTA (SEQ ID NO: 688): [Model Cell line information]: cell:
NCIH1573: cancer_type: LUNG: PAM_dist: 9: indel length: 0: CRISPR gRNA ID: GF-
CCELg12-213: [crRNA sequence]: crRNA sequence: TTTATGTAATTTTATTAAAGATTTTGCT
(SEQ ID NO: 689): LbgRNA: AATTCTAATACGACTCACTATAGgtaatttctactaagtgtagat
TGTAATTTTATTAAAGATTTTGCT (SEQ ID NO: 690): [Target gene information]: Gene ID:
5290: Symbol: PIK3CA: Ensembl_Transcript_ID: ENST00000263967.3: GRCh: 37: Chr: 3:
[Target cancer mutation information]: mut_start: 178917478: mut_end: 178917478: mut_class:
Splice_Site: mut_type: SNP: ref_seq: G: mut_seq: A: mut_aa: p.G118D: mutation info source:
CCLE: ref_target(-10 +10): TTTATTAAAGGTTTTGCTATC (SEQ ID NO: 691): mut_target(-10
+10): TTTATTAAAGATTTTGCTATC (SEQ ID NO: 692): [Model Cell line information]: cell:
NCIH1975: cancer_type: LUNG: PAM_dist: 17: indel length: 0: CRISPR gRNA ID: GF-
CCELg12-214: [crRNA sequence]: crRNA sequence: TTTATTAAAGATTTTGCTATCGGCATGC
(SEQ ID NO: 693): LbgRNA: AATTCTAATACGACTCACTATAGgtaatttctactaagtgtagat
TTAAAGATTTTGCTATCGGCATGC (SEQ ID NO: 694): [Target gene information]: Gene ID:
5290: Symbol: PIK3CA: Ensembl_Transcript_ID: ENST00000263967.3: GRCh: 37: Chr: 3:
[Target cancer mutation information]: mut_start: 178917478: mut_end: 178917478: mut_class:
Splice_Site: mut_type: SNP: ref_seq: G: mut_seq: A: mut_aa: p.G118D: mutation info source:
CCLE: ref_target(-10 +10): TTTATTAAAGGTTTTGCTATC (SEQ ID NO: 691): mut_target(-10
+10): TTTATTAAAGATTTTGCTATC (SEQ ID NO: 692): [Model Cell line information]: cell:
NCIH1975: cancer_type: LUNG: PAM_dist: 7: indel length: 0: CRISPR gRNA ID: GF-
CCELg12-215: [crRNA sequence]: crRNA sequence: TTTTATTAAAGATTTTGCTATCGGCATG
(SEQ ID NO: 695): LbgRNA: AATTCTAATACGACTCACTATAGgtaatttctactaagtgtagat
ATTAAAGATTTTGCTATCGGCATG (SEQ ID NO: 696): [Target gene information]: Gene ID:

TABLE 6-continued

Illustrative guide RNA sequences for Cas12 comprising poylpeptide

5290: Symbol: PIK3CA: Ensembl_Transcript_ID: ENST00000263967.3: GRCh: 37: Chr: 3:
[Target cancer mutation information]: mut_start: 178917478: mut_end: 178917478: mut_class:
Splice_Site: mut_type: SNP: ref_seq: G: mut_seq: A: mut_aa: p.G118D: mutation info source:
CCLE: ref_target(-10 +10): TTTATTAAAGGTTTTGCTATC (SEQ ID NO: 691): mut_target(-10
+10): TTTATTAAAGATTTTGCTATC (SEQ ID NO: 692): [Model Cell line information]: cell:
NCIH1975: cancer_type: LUNG: PAM_dist: 8: indel length: 0: CRISPR gRNA ID: GF-
CCELg12-216: [crRNA sequence]: crRNA sequence: TTTCTCCTGCTTAGTGATTTCAGAGAGA
(SEQ ID NO: 697): LbgRNA: AATTCTAATACGACTCACTATAGgtaatttctactaagtgtagat
TCCTGCTTAGTGATTTCAGAGAGA (SEQ ID NO: 698): [Target gene information]: Gene ID:
5290: Symbol: PIK3CA: Ensembl_Transcript_ID: ENST00000263967.3: GRCh: 37: Chr: 3:
[Target cancer mutation information]: mut_start: 178936091: mut_end: 178936091: mut_class:
Missense_Mutation: mut_type: SNP: ref_seq: G: mut_seq: A: mut_aa: p.E545K: mutation info
source: CCLE: ref_target(-10 +10): TGAAATCACTGAGCAGGAGAA (SEQ ID NO: 699):
mut_target(-10 +10): TGAAATCACTAAGCAGGAGAA (SEQ ID NO: 700): [Model Cell line
information]: cell: NCIH460: cancer_type: LUNG: PAM_dist: 8: indel length: 0: CRISPR gRNA
ID: GF-CCELg12-217: [crRNA sequence]: crRNA sequence:
TTTCTACACGAGATCCTCTCTAAAAT (SEQ ID NO: 701): LbgRNA:
AATTCTAATACGACTCACTATAGgtaatttctactaagtgtagat TACACGAGATCCTCTCTAAAAT
(SEQ ID NO: 702): [Target gene information]: Gene ID: 5290: Symbol: PIK3CA:
Ensembl_Transcript_ID: ENST00000263967.3: GRCh: 37: Chr: 3: [Target cancer mutation
information]: mut_start: 178936082: mut_end: 178936082: mut_class: Missense_Mutation:
mut_type: SNP: ref_seq: G: mut_seq: A: mut_aa: p.E542K: mutation info source: CCLE:
ref_target(-10 +10): TCCTCTCTCTGAAATCACTGA (SEQ ID NO: 703): mut_target(-10 +10):
TCCTCTCTCTAAAATCACTGA (SEQ ID NO: 704): [Model Cell line information]: cell:
NCIH1563: cancer_type: LUNG: PAM_dist: 20: indel length: 0: CRISPR gRNA ID: GF-
CCELg12-218: [crRNA sequence]: crRNA sequence: TTTCTCCTGCTCAGTGATTTTAGAGAGA
(SEQ ID NO: 705): LbgRNA: AATTCTAATACGACTCACTATAGgtaatttctactaagtgtagat
TCCTGCTCAGTGATTTTAGAGAGA (SEQ ID NO: 706): [Target gene information]: Gene ID:
5290: Symbol: PIK3CA: Ensembl_Transcript_ID: ENST00000263967.3: GRCh: 37: Chr: 3:
[Target cancer mutation information]: mut_start: 178936082: mut_end: 178936082: mut_class:
Missense_Mutation: mut_type: SNP: ref_seq: G: mut_seq: A: mut_aa: p.E542K: mutation info
source: CCLE: ref_target(-10 +10): TCCTCTCTCTGAAATCACTGA (SEQ ID NO: 703):
mut_target(-10 +10): TCCTCTCTCTAAAATCACTGA (SEQ ID NO: 704): [Model Cell line
information]: cell: NCIH1563: cancer_type: LUNG: PAM_dist: 17: indel length: 0: CRISPR
gRNA ID: GF-CCELg12-219: [crRNA sequence]: crRNA sequence:
TTTAGAGAGAGGATCTCGTGTAGAAATT (SEQ ID NO: 707): LbgRNA:
AATTCTAATACGACTCACTATAGgtaatttctactaagtgtagat GAGAGAGGATCTCGTGTAGAAATT
(SEQ ID NO: 708): [Target gene information]: Gene ID: 5290: Symbol: PIK3CA:
Ensembl_Transcript_ID: ENST00000263967.3: GRCh: 37: Chr: 3: [Target cancer mutation
information]: mut_start: 178936082: mut_end: 178936082: mut_class: Missense_Mutation:
mut_type: SNP: ref_seq: G: mut_seq: A: mut_aa: p.E542K: mutation info source: CCLE:
ref_target(-10 +10): TCCTCTCTCTGAAATCACTGA (SEQ ID NO: 703): mut_target(-10 +10):
TCCTCTCTCTAAAATCACTGA (SEQ ID NO: 704): [Model Cell line information]: cell:
NCIH1563: cancer_type: LUNG: PAM_dist: -1: indel length: 0: CRISPR gRNA ID: GF-
CCELg12-220: [crRNA sequence]: crRNA sequence:
TTTTAGAGAGAGGATCTCGTGTAGAAAT (SEQ ID NO: 709): LbgRNA:
AATTCTAATACGACTCACTATAGgtaatttctactaagtgtagat AGAGAGAGGATCTCGTGTAGAAAT
(SEQ ID NO: 710): [Target gene information]: Gene ID: 5290: Symbol: PIK3CA:
Ensembl_Transcript_ID: ENST00000263967.3: GRCh: 37: Chr: 3: [Target cancer mutation
information]: mut_start: 178936082: mut_end: 178936082: mut_class: Missense_Mutation:
mut_type: SNP: ref_seq: G: mut_seq: A: mut_aa: p.E542K: mutation info source: CCLE:
ref_target(-10 +10): TCCTCTCTCTGAAATCACTGA (SEQ ID NO: 703): mut_target(-10 +10):
TCCTCTCTCTAAAATCACTGA (SEQ ID NO: 704): [Model Cell line information]: cell:
NCIH1563: cancer_type: LUNG: PAM_dist: 0: indel length: 0: CRISPR gRNA ID: GF-
CCELg12-221: [crRNA sequence]: crRNA sequence: TTTCCGTGAACTTACGTAGAATATATTG
(SEQ ID NO: 711): LbgRNA: AATTCTAATACGACTCACTATAGgtaatttctactaagtgtagat
CGTGAACTTACGTAGAATATATTG (SEQ ID NO: 712): [Target gene information]: Gene ID:
5295: Symbol: PIK3R1: Ensembl_Transcript_ID: ENST00000521381.1: GRCh: 37: Chr: 5:
[Target cancer mutation information]: mut_start: 67522714: mut_end: 67522714: mut_class:
Nonsense_Mutation: mut_type: SNP: ref_seq: G: mut_seq: T: mut_aa: p.G71*: mutation info
source: CCLE: ref_target(-10 +10): GGACTTTCCGGGAACTTACGT (SEQ ID NO: 713):
mut_target(-10 +10): GGACTTTCCGTGAACTTACGT (SEQ ID NO: 714): [Model Cell line
information]: cell: NCIH1573: cancer_type: LUNG: PAM_dist: 3: indel length: 0: CRISPR
gRNA ID: GF-CCELg12-222: [crRNA sequence]: crRNA sequence:
TTTGAAAGCGTCAGCCAAAACGTGAACA (SEQ ID NO: 715): LbgRNA:
AATTCTAATACGACTCACTATAGgtaatttctactaagtgtagat AAAGCGTCAGCCAAAACGTGAACA
(SEQ ID NO: 716): [Target gene information]: Gene ID: 5295: Symbol: PIK3R1:
Ensembl_Transcript_ID: ENST00000521381.1: GRCh: 37: Chr: 5: [Target cancer mutation
information]: mut_start: 67575464: mut_end: 67575464: mut_class: Silent: mut_type: SNP:
ref_seq: G: mut_seq: T: mut_aa: p.V179V: mutation info source: CCLE: ref_target(-10 +10):
TGATCGATGTGCACGTTTTGG (SEQ ID NO: 717): mut_target(-10 +10):
TGATCGATGTTCACGTTTTGG (SEQ ID NO: 718): [Model Cell line information]: cell:
NCIH1573: cancer_type: LUNG: PAM_dist: 21: indel length: 0: CRISPR gRNA ID: GF-
CCELg12-223: [crRNA sequence]: crRNA sequence: TTTCTCATCATAATGGGCCAGGTTTTCA
(SEQ ID NO: 719): LbgRNA: AATTCTAATACGACTCACTATAGgtaatttctactaagtgtagat
TCATCATAATGGGCCAGGTTTTCA (SEQ ID NO: 720): [Target gene information]: Gene ID:
8503: Symbol: PIK3R3: Ensembl_Transcript_ID: ENST00000262741.5: GRCh: 37: Chr: 1:
[Target cancer mutation information]: mut_start: 46511726: mut_end: 46511726: mut_class:

TABLE 6-continued

Illustrative guide RNA sequences for Cas12 comprising poylpeptide

Missense_Mutation: mut_type: SNP: ref_seq: G: mut_seq: C: mut_aa: p.P351A: mutation info
source: CCLE: ref_target(-10 +10): TCATAATGGGGCAGGTTTTCA (SEQ ID NO: 721):
mut_target(-10 +10): TCATAATGGGCCAGGTTTTCA (SEQ ID NO: 722): [Model Cell line
information]: cell: NCIH661: cancer_type: LUNG: PAM_dist: 14: indel length: 0: CRISPR
gRNA ID: GF-CCELg12-224: [crRNA sequence]: crRNA sequence:
TTTTCTCATAATGGGCCAGGTTTTC (SEQ ID NO: 723): LbgRNA:
AATTCTAATACGACTCACTATAGgtaatttctactaagtgtagat CTCATCATAATGGGCCAGGTTTTC
(SEQ ID NO: 724): [Target gene information]: Gene ID: 8503: Symbol: PIK3R3:
Ensembl_Transcript_ID: ENST00000262741.5: GRCh: 37: Chr: 1: [Target cancer mutation
information]: mut_start: 46511726: mut_end: 46511726: mut_class: Missense_Mutation:
mut_type: SNP: ref_seq: G: mut_seq: C: mut_aa: p.P351A: mutation info source: CCLE:
ref_target(-10 +10): TCATAATGGGGCAGGTTTTCA (SEQ ID NO: 721): mut_target(-10 +10):
TCATAATGGGCCAGGTTTTCA (SEQ ID NO: 722): [Model Cell line information]: cell:
NCIH661: cancer_type: LUNG: PAM_dist: 15: indel length: 0: CRISPR gRNA ID: GF-
CCELg12-225: [crRNA sequence]: crRNA sequence:
TTTATCAATGAGGAAGATGAAAACCTGG  (SEQ ID NO: 725): LbgRNA:
AATTCTAATACGACTCACTATAGgtaatttctactaagtgtagat TCAATGAGGAAGATGAAAACCTGG
(SEQ ID NO: 726): [Target gene information]: Gene ID: 8503: Symbol: PIK3R3:
Ensembl_Transcript_ID: ENST00000262741.5: GRCh: 37: Chr: 1: [Target cancer mutation
information]: mut_start: 46511726: mut_end: 46511726: mut_class: Missense_Mutation:
mut_type: SNP: ref_seq: G: mut_seq: C: mut_aa: p.P351A: mutation info source: CCLE:
ref_target(-10 +10): TCATAATGGGGCAGGTTTTCA (SEQ ID NO: 721): mut_target(-10 +10):
TCATAATGGGCCAGGTTTTCA (SEQ ID NO: 722): [Model Cell line information]: cell:
NCIH661: cancer_type: LUNG: PAM_dist: 24: indel length: 0: CRISPR gRNA ID: GF-
CCELg12-226: [crRNA sequence]: crRNA sequence:
TTTGCAAAGCTACCCTGAAAGGAAACAA (SEQ ID NO: 727): LbgRNA:
AATTCTAATACGACTCACTATAGgtaatttctactaagtgtagat CAAAGCTACCCTGAAAGGAAACAA
(SEQ ID NO: 728): [Target gene information]: Gene ID: 10769: Symbol: PLK2:
Ensembl_Transcript_ID: ENST00000274289.3: GRCh: 37: Chr: 5: [Target cancer mutation
information]: mut_start: 57754916: mut_end: 57754916: mut_class: Missense_Mutation:
mut_type: SNP: ref_seq: C: mut_seq: T: mut_aa: p.G925: mutation info source: CCLE:
ref_target(-10 +10): TTTGCAAAGCCACCCTGAAAG (SEQ ID NO: 729): mut_target(-10 +10):
TTTGCAAAGCTACCCTGAAAG (SEQ ID NO: 730): [Model Cell line information]: cell:
NCIH2126: cancer_type: LUNG: PAM_dist: 7: indel length: 0: CRISPR gRNA ID: GF-
CCELg12-227: [crRNA sequence]: crRNA sequence:
TTTTGCAAAGCTACCCTGAAAGGAAACA (SEQ ID NO: 731): LbgRNA:
AATTCTAATACGACTCACTATAGgtaatttctactaagtgtagat GCAAAGCTACCCTGAAAGGAAACA
(SEQ ID NO: 732): [Target gene information]: Gene ID: 10769: Symbol: PLK2:
Ensembl_Transcript_ID: ENST00000274289.3: GRCh: 37: Chr: 5: [Target cancer mutation
information]: mut_start: 57754916: mut_end: 57754916: mut_class: Missense_Mutation:
mut_type: SNP: ref_seq: C: mut_seq: T: mut_aa: p.G925: mutation info source: CCLE:
ref_target(-10 +10): TTTGCAAAGCCACCCTGAAAG (SEQ ID NO: 729): mut_target(-10 +10):
TTTGCAAAGCTACCCTGAAAG (SEQ ID NO: 730): [Model Cell line information]: cell:
NCIH2126: cancer_type: LUNG: PAM_dist: 8: indel length: 0: CRISPR gRNA ID: GF-
CCELg12-228: [crRNA sequence]: crRNA sequence: TTTCCTTTCAGGGTAGCTTTGCAAAATG
(SEQ ID NO: 733): LbgRNA: AATTCTAATACGACTCACTATAGgtaatttctactaagtgtagat
CTTTCAGGGTAGCTTTGCAAAATG (SEQ ID NO: 734): [Target gene information]: Gene ID:
10769: Symbol: PLK2: Ensembl_Transcript_ID: ENST00000274289.3: GRCh: 37: Chr: 5:
[Target cancer mutation information]: mut_start: 57754916: mut_end: 57754916: mut_class:
Missense_Mutation: mut_type: SNP: ref_seq: C: mut_seq: T: mut_aa: p.G92S: mutation info
source: CCLE: ref_target(-10 +10): TTTGCAAAGCCACCCTGAAAG (SEQ ID NO: 729):
mut_target(-10 +10): TTTGCAAAGCTACCCTGAAAG (SEQ ID NO: 730): [Model Cell line
information]: cell: NCIH2126: cancer_type: LUNG: PAM_dist: 11: indel length: 0: CRISPR
gRNA ID: GF-CCELg12-229: [crRNA sequence]: crRNA sequence:
TTTCAGGGTAGCTTTGCAAAATGTTACG (SEQ ID NO: 735): LbgRNA:
AATTCTAATACGACTCACTATAGgtaatttctactaagtgtagat AGGGTAGCTTTGCAAAATGTTACG
(SEQ ID NO: 736): [Target gene information]: Gene ID: 10769: Symbol: PLK2:
Ensembl_Transcript_ID: ENST00000274289.3: GRCh: 37: Chr: 5: [Target cancer mutation
information]: mut_start: 57754916: mut_end: 57754916: mut_class: Missense_Mutation:
mut_type: SNP: ref_seq: C: mut_seq: T: mut_aa: p.G92S: mutation info source: CCLE:
ref_target(-10 +10): TTTGCAAAGCCACCCTGAAAG (SEQ ID NO: 729): mut_target(-10 +10):
TTTGCAAAGCTACCCTGAAAG (SEQ ID NO: 730): [Model Cell line information]: cell:
NCIH2126: cancer_type: LUNG: PAM_dist: 6: indel length: 0: CRISPR gRNA ID: GF-
CCELg12-230: [crRNA sequence]: crRNA sequence: TTTGTTTCCTTTCAGGGTAGCTTTGCAA
(SEQ ID NO: 737): LbgRNA: AATTCTAATACGACTCACTATAGgtaatttctactaagtgtagat
TTTCCTTTCAGGGTAGCTTTGCAA (SEQ ID NO: 738): [Target gene information]: Gene ID:
10769: Symbol: PLK2: Ensembl_Transcript_ID: ENST00000274289.3: GRCh: 37: Chr: 5:
[Target cancer mutation information]: mut_start: 57754916: mut_end: 57754916: mut_class:
Missense_Mutation: mut_type: SNP: ref_seq: C: mut_seq: T: mut_aa: p.G92S: mutation info
source: CCLE: ref_target(-10 +10): TTTGCAAAGCCACCCTGAAAG (SEQ ID NO: 729):
mut_target(-10 +10): TTTGCAAAGCTACCCTGAAAG (SEQ ID NO: 730): [Model Cell line
information]: cell: NCIH2126: cancer_type: LUNG: PAM_dist: 15: indel length: 0: CRISPR
gRNA ID: GF-CCELg12-231: [crRNA sequence]: crRNA sequence:
TTTGGCGAAGGCCAAGAGGCCGCCCACC (SEQ ID NO: 739): LbgRNA:
AATTCTAATACGACTCACTATAGgtaatttctactaagtgtagat GCGAAGGCCAAGAGGCCGCCCACC
(SEQ ID NO: 740): [Target gene information]: Gene ID: 5424: Symbol: POLD1:
Ensembl_Transcript_ID: ENST00000440232.2: GRCh: 37: Chr: 19: [Target cancer mutation
information]: mut_start: 50919920: mut_end: 50919920: mut_class: Silent: mut_type: SNP:

TABLE 6-continued

Illustrative guide RNA sequences for Cas12 comprising poylpeptide ref_seq: C: mut_seq: T: mut_aa: p.L1003L: mutation info source: CCLE: ref_target(-10 +10):
GGGCGGCCTCCTGGCCTTCGC (SEQ ID NO: 741): mut_target(-10 +10):
GGGCGGCCTCTTGGCCTTCGC (SEQ ID NO: 742): [Model Cell line information]: cell: A549:
cancer_type: LUNG: PAM_dist: 11: indel length: 0: CRISPR gRNA ID: GF-CCELg12-232:
[crRNA sequence]: crRNA sequence: TTTCAACAGTTGGAGATTGACCATTATG (SEQ ID NO:
743): LbgRNA: AATTCTAATACGACTCACTATAGgtaatttctactaagtgtagat
AACAGTTGGAGATTGACCATTATG (SEQ ID NO: 744): [Target gene information]: Gene ID:
5424: Symbol: POLD1: Ensembl_Transcript_ID: ENST00000440232.2: GRCh: 37: Chr: 19:
[Target cancer mutation information]: mut_start: 50902713: mut_end: 50902713: mut_class: Silent:
mut_type: SNP: ref_seq: C: mut_seq: T: mut_aa: p.F96F: mutation info source: CCLE:
ref_target(-10 +10): CCCTCATCTTCCAACAGTTGG (SEQ ID NO: 745): mut_target(-10 +10):
CCCTCATCTTTCAACAGTTGG (SEQ ID NO: 746): [Model Cell line information]: cell:
NCIH1563: cancer_type: LUNG: PAM_dist: -1: indel length: 0: CRISPR gRNA ID: GF-
CCELg12-233: [crRNA sequence]: crRNA sequence:
TTTCACTCAGGGATGATGCGCCACTTCC (SEQ ID NO: 747): LbgRNA:
AATTCTAATACGACTCACTATAGgtaatttctactaagtgtagat ACTCAGGGATGATGCGCCACTTCC
(SEQ ID NO: 748): [Target gene information]: Gene ID: 5426: Symbol: POLE:
Ensembl_Transcript_ID: ENST00000320574.5: GRCh: 37: Chr: 12: [Target cancer mutation
information]: mut_start: 133257857: mut_end: 133257857: mut_class: Frame_Shift_Del:
mut_type: DEL: ref_seq: C: mut_seq: -: mut_aa: p.G24fs: mutation info source: CCLE:
ref_target(-10 +10): GGAAGTGGCGCCATCATCCCT (SEQ ID NO: 749): mut_target(-10 +10):
GGAAGTGGCG-CATCATCCCT (SEQ ID NO: 750): [Model Cell line information]: cell:
NCIH2126: cancer_type: LUNG: PAM_dist: 15: indel length: 1: CRISPR gRNA ID: GF-
CCELg12-234: [crRNA sequence]: crRNA sequence:
TTTGCCCGGGAGCACTTGTGGGGGTTCA (SEQ ID NO: 751): LbgRNA:
AATTCTAATACGACTCACTATAGgtaatttctactaagtgtagat CCCGGGAGCACTTGTGGGGGTTCA
(SEQ ID NO: 752): [Target gene information]: Gene ID: 8493: Symbol: PPM1D:
Ensembl_Transcript_ID: ENST00000305921.3: GRCh: 37: Chr: 17: [Target cancer mutation
information]: mut_start: 58678141: mut_end: 58678141: mut_class: Silent: mut_type: SNP:
ref_seq: T: mut_seq: G: mut_aa: p.G122G: mutation info source: CCLE: ref_target(-10 +10):
ACTTGTGGGGTTTCATCAAGA (SEQ ID NO: 753): mut_target(-10 +10):
ACTTGTGGGGGTTCATCAAGA (SEQ ID NO: 754): [Model Cell line information]: cell: HPAFII:
cancer_type: PANCREAS: PAM_dist: 20: indel length: 0: CRISPR gRNA ID: GF-CCELg12-
235: [crRNA sequence]: crRNA sequence: TTTCCATTGCAACTCCCGCCACGTGATT (SEQ ID
NO: 755): LbgRNA: AATTCTAATACGACTCACTATAGgtaatttctactaagtgtagat
CATTGCAACTCCCGCCACGTGATT (SEQ ID NO: 756): [Target gene information]: Gene ID:
5071: Symbol: PARK2: Ensembl_Transcript_ID: ENST00000366898.1: GRCh: 37: Chr: 6:
[Target cancer mutation information]: mut_start: 162206919: mut_end: 162206919: mut_class:
Missense_Mutation: mut_type: SNP: ref_seq: C: mut_seq: A: mut_aa: p.Q252H: mutation info
source: CCLE: ref_target(-10 +10): GGGAGTTGCACTGGAAAACCA (SEQ ID NO: 757):
mut_target(-10 +10): GGGAGTTGCAATGGAAAACCA (SEQ ID NO: 758): [Model Cell line
information]: cell: NCIH1975: cancer_type: LUNG: PAM_dist: 3: indel length: 0: CRISPR
gRNA ID: GF-CCELg12-236: [crRNA sequence]: crRNA sequence:
TTTTCCATTGCAACTCCCGCCACGTGAT (SEQ ID NO: 759): LbgRNA:
AATTCTAATACGACTCACTATAGgtaatttctactaagtgtagat CCATTGCAACTCCCGCCACGTGAT
(SEQ ID NO: 760): [Target gene information]: Gene ID: 5071: Symbol: PARK2:
Ensembl_Transcript_ID: ENST00000366898.1: GRCh: 37: Chr: 6: [Target cancer mutation
information]: mut_start: 162206919: mut_end: 162206919: mut_class: Missense_Mutation:
mut_type: SNP: ref_seq: C: mut_seq: A: mut_aa: p.Q252H: mutation info source: CCLE:
ref_target(-10 +10): GGGAGTTGCACTGGAAAACCA (SEQ ID NO: 757): mut_target(-10 +10):
GGGAGTTGCAATGGAAAACCA (SEQ ID NO: 758): [Model Cell line information]: cell:
NCIH1975: cancer_type: LUNG: PAM_dist: 4: indel length: 0: CRISPR gRNA ID: GF-
CCELg12-237: [crRNA sequence]: crRNA sequence: TTTGTTTGAATTTTTGTTGGGGGCTGTG
(SEQ ID NO: 761): LbgRNA: AATTCTAATACGACTCACTATAGgtaatttctactaagtgtagat
TTTGAATTTTTGTTGGGGGCTGTG (SEQ ID NO: 762): [Target gene information]: Gene ID:
5727: Symbol: PTCH1: Ensembl_Transcript_ID: ENST00000331920.6: GRCh: 37: Chr: 9:
[Target cancer mutation information]: mut_start: 98242676: mut_end: 98242676: mut_class:
Missense_Mutation: mut_type: SNP: ref_seq: G: mut_seq: T: mut_aa: p.T314N: mutation info
source: CCLE: ref_target(-10 +10): ACTCACTTTGGTTGAATTTTT (SEQ ID NO: 763):
mut_target(-10 +10): ACTCACTTTGTTTGAATTTTT (SEQ ID NO: 764): [Model Cell line
information]: cell: HCC827GR5: cancer_type: LUNG: PAM_dist: 1: indel length: 0: CRISPR
gRNA ID: GF-CCELg12-238: [crRNA sequence]: crRNA sequence:
TTTGAATTTTTGTTGGGGGCTGTGGCGG (SEQ ID NO: 765): LbgRNA:
AATTCTAATACGACTCACTATAGgtaatttctactaagtgtagat AATTTTTGTTGGGGGCTGTGGCGG
(SEQ ID NO: 766): [Target gene information]: Gene ID: 5727: Symbol: PTCH1:
Ensembl_Transcript_ID: ENST00000331920.6: GRCh: 37: Chr: 9: [Target cancer mutation
information]: mut_start: 98242676: mut_end: 98242676: mut_class: Missense_Mutation:
mut_type: SNP: ref_seq: G: mut_seq: T: mut_aa: p.T314N: mutation info source: CCLE:
ref_target(-10 +10): ACTCACTTTGGTTGAATTTTT (SEQ ID NO: 763): mut_target(-10 +10):
ACTCACTTTGTTTGAATTTTT (SEQ ID NO: 764): [Model Cell line information]: cell:
HCC827GR5: cancer_type: LUNG: PAM_dist: -3: indel length: 0: CRISPR gRNA ID: GF-
CCELg12-239: [crRNA sequence]: crRNA sequence: TTTGTTTGAATTTTTGTTGGGGGCTGTG
(SEQ ID NO: 761): LbgRNA: AATTCTAATACGACTCACTATAGgtaatttctactaagtgtagat
TTTGAATTTTTGTTGGGGGCTGTG (SEQ ID NO: 762): [Target gene information]: Gene ID:
5727: Symbol: PTCH1: Ensembl_Transcript_ID: ENST00000331920.6: GRCh: 37: Chr: 9:
[Target cancer mutation information]: mut_start: 98242676: mut_end: 98242676: mut_class:
Missense_Mutation: mut_type: SNP: ref_seq: G: mut_seq: T: mut_aa: p.T314N: mutation info
source: CCLE: ref_target(-10 +10): ACTCACTTTGGTTGAATTTTT (SEQ ID NO: 763):

TABLE 6-continued

Illustrative guide RNA sequences for Cas12 comprising poylpeptide mut_target(-10 +10): ACTCACTTTGTTTGAATTTTT (SEQ ID NO: 764) [Model Cell line
information]: cell: HCC827: cancer_type: LUNG: PAM_dist: 1: indel length: 0: CRISPR gRNA
ID: GF-CCELg12-240: [crRNA sequence]: crRNA sequence:
TTTGAATTTTTGTTGGGGGCTGTGGCGG (SEQ ID NO: 765): LbgRNA:
AATTCTAATACGACTCACTATAGgtaatttctactaagtgtagat AATTTTTGTTGGGGGCTGTGGCGG
(SEQ ID NO: 766): [Target gene information]: Gene ID: 5727: Symbol: PTCH1:
Ensembl_Transcript_ID: ENST00000331920.6: GRCh: 37: Chr: 9: [Target cancer mutation
information]: mut_start: 98242676: mut_end: 98242676: mut_class: Missense_Mutation:
mut_type: SNP: ref_seq: G: mut_seq: T: mut_aa: p.T314N: mutation info source: CCLE:
ref_target(-10 +10): ACTCACTTTGGTTGAATTTTT (SEQ ID NO: 763): mut_target(-10 +10):
ACTCACTTTGTTTGAATTTTT (SEQ ID NO: 764) [Model Cell line information]: cell: HCC827:
cancer_type: LUNG: PAM_dist: -3: indel length: 0: CRISPR gRNA ID: GF-CCELg12-241:
[crRNA sequence]: crRNA sequence: TTTTTTTGAATGTAACAACCCAGTTTAA (SEQ ID NO:
767): LbgRNA: AATTCTAATACGACTCACTATAGgtaatttctactaagtgtagat
TTTGAATGTAACAACCCAGTTTAA (SEQ ID NO: 768): [Target gene information]: Gene ID:
5727: Symbol: PTCH1: Ensembl_Transcript_ID: ENST00000331920.6: GRCh: 37: Chr: 9:
[Target cancer mutation information]: mut_start: 98268792: mut_end: 98268793: mut_class:
Frame_Shift_Ins: mut_type: INS: ref_seq: -: mut_seq: T: mut_aa: p.N97fs: mutation info source:
CCLE: ref_target(-10 +10): ACTTGCCGCA_TTTTTTTGAAT (SEQ ID NO: 769): mut_target(-10
+10): ACTTGCCGCATTTTTTTGAAT (SEQ ID NO: 770): [Model Cell line information]: cell:
NCIH460: cancer_type: LUNG: PAM_dist: -3: indel length: 1: CRISPR gRNA ID: GF-
CCELg12-242: [crRNA sequence]: crRNA sequence:
TTTCTATGGGGAAGTAAGAACCAGAGAC (SEQ ID NO: 771): LbgRNA:
AATTCTAATACGACTCACTATAGgtaatttctactaagtgtagat TATGGGGAAGTAAGAACCAGAGAC
(SEQ ID NO: 772): [Target gene information]: Gene ID: 5728: Symbol: PTEN:
Ensembl_Transcript_ID: ENST00000371953.3: GRCh: 37: Chr: 10: [Target cancer mutation
information]: mut_start: 89692993: mut_end: 89692993: mut_class: Silent: mut_type: SNP:
ref_seq: G: mut_seq: A: mut_aa: p.R159R: mutation info source: CCLE: ref_target(-10 +10):
GGGAAGTAAGGACCAGAGACA (SEQ ID NO: 773): mut_target(-10 +10):
GGGAAGTAAGAACCAGAGACA (SEQ ID NO: 774): [Model Cell line information]: cell:
NCIH1563: cancer_type: LUNG: PAM_dist: 15: indel length: 0: CRISPR gRNA ID: GF-
CCELg12-243: [crRNA sequence]: crRNA sequence: TTTGTCTCTGGTTCTTACTTCCCCATAG
(SEQ ID NO: 775): LbgRNA: AATTCTAATACGACTCACTATAGgtaatttctactaagtgtagat
TCTCTGGTTCTTACTTCCCCATAG (SEQ ID NO: 776): [Target gene information]: Gene ID:
5728: Symbol: PTEN: Ensembl_Transcript_ID: ENST00000371953.3: GRCh: 37: Chr: 10:
[Target cancer mutation information]: mut_start: 89692993: mut_end: 89692993: mut_class: Silent:
mut_type: SNP: ref_seq: G: mut_seq: A: mut_aa: p.R159R: mutation info source: CCLE:
ref_target(-10 +10): GGGAAGTAAGGACCAGAGACA (SEQ ID NO: 773): mut_target(-10 +10):
GGGAAGTAAGAACCAGAGACA (SEQ ID NO: 774): [Model Cell line information]: cell:
NCIH1563: cancer_type: LUNG: PAM_dist: 9: indel length: 0: CRISPR gRNA ID: GF-
CCELg12-244: [crRNA sequence]: crRNA sequence: TTTTTGTCTCTGGTTCTTACTTCCCCAT
(SEQ ID NO: 777): LbgRNA: AATTCTAATACGACTCACTATAGgtaatttctactaagtgtagat
TGTCTCTGGTTCTTACTTCCCCAT (SEQ ID NO: 778): [Target gene information]: Gene ID:
5728: Symbol: PTEN: Ensembl_Transcript_ID: ENST00000371953.3: GRCh: 37: Chr: 10:
[Target cancer mutation information]: mut_start: 89692993: mut_end: 89692993: mut_class: Silent:
mut_type: SNP: ref_seq: G: mut_seq: A: mut_aa: p.R159R: mutation info source: CCLE:
ref_target(-10 +10): GGGAAGTAAGGACCAGAGACA (SEQ ID NO: 773): mut_target(-10 +10):
GGGAAGTAAGAACCAGAGACA (SEQ ID NO: 774): [Model Cell line information]: cell:
NCIH1563: cancer_type: LUNG: PAM_dist: 11: indel length: 0: CRISPR gRNA ID: GF-
CCELg12-245: [crRNA sequence]: crRNA sequence: TTTTGTCTCTGGTTCTTACTTCCCCATA
(SEQ ID NO: 779): LbgRNA: AATTCTAATACGACTCACTATAGgtaatttctactaagtgtagat
GTCTCTGGTTCTTACTTCCCCATA (SEQ ID NO: 780): [Target gene information]: Gene ID:
5728: Symbol: PTEN: Ensembl_Transcript_ID: ENST00000371953.3: GRCh: 37: Chr: 10:
[Target cancer mutation information]: mut_start: 89692993: mut_end: 89692993: mut_class: Silent:
mut_type: SNP: ref_seq: G: mut_seq: A: mut_aa: p.R159R: mutation info source: CCLE:
ref_target(-10 +10): GGGAAGTAAGGACCAGAGACA (SEQ ID NO: 773): mut_target(-10 +10):
GGGAAGTAAGAACCAGAGACA (SEQ ID NO: 774): [Model Cell line information]: cell:
NCIH1563: cancer_type: LUNG: PAM_dist: 10: indel length: 0: CRISPR gRNA ID: GF-
CCELg12-246: [crRNA sequence]: crRNA sequence: TTTCGTTGTCATGACAATCACTCAGGAG
(SEQ ID NO: 781): LbgRNA: AATTCTAATACGACTCACTATAGgtaatttctactaagtgtagat
GTTGTCATGACAATCACTCAGGAG (SEQ ID NO: 782): [Target gene information]: Gene ID:
5781: Symbol: PTPN11: Ensembl_Transcript_ID: ENST00000351677.2: GRCh: 37: Chr: 12:
[Target cancer mutation information]: mut_start: 112915778: mut_end: 112915778: mut_class:
Nonsense_Mutation: mut_type: SNP: ref_seq: C: mut_seq: T: mut_aa: p.R351*: mutation info
source: CCLE: ref_target(-10 +10): AGAAAACTCCCGAGTGATTGT (SEQ ID NO: 783):
mut_target(-10 +10): AGAAAACTCCTGAGTGATTGT (SEQ ID NO: 784): [Model Cell line
information]: cell: NCIH1573: cancer_type: LUNG: PAM_dist: 20: indel length: 0: CRISPR
gRNA ID: GF-CCELg12-247: [crRNA sequence]: crRNA sequence:
TTTAGGTAAGGCTTGGATGGGGGAAGAT (SEQ ID NO: 785): LbgRNA:
AATTCTAATACGACTCACTATAGgtaatttctactaagtgtagat GGTAAGGCTTGGATGGGGAAGAT
(SEQ ID NO: 786): [Target gene information]: Gene ID: 5789: Symbol: PTPRD:
Ensembl_Transcript_ID: ENST00000381196.4: GRCh: 37: Chr: 9: [Target cancer mutation
information]: mut_start: 8518422: mut_end: 8518422: mut_class: Silent: mut_type: SNP:
ref_seq: G: mut_seq: A: mut_aa: p.P323P: mutation info source: CCLE: ref_target(-10 +10):
CTGGAGGTTTGGGTAAGGCTT (SEQ ID NO: 787): mut_target(-10 +10):
CTGGAGGTTTAGGTAAGGCTT (SEQ ID NO: 788): [Model Cell line information]: cell:

TABLE 6-continued

Illustrative guide RNA sequences for Cas12 comprising poylpeptide

NCIH460: cancer_type: LUNG: PAM_dist: 0: indel length: 0: CRISPR gRNA ID: GF-CCELg12-
248: [crRNA sequence]: crRNA sequence: TTTATCTTCCCCCATCCAAGCCTTACCT   (SEQ ID
NO: 789): LbgRNA: AATTCTAATACGACTCACTATAGgtaatttctactaagtgtagat
TCTTCCCCCATCCAAGCCTTACCT (SEQ ID NO: 790): [Target gene information]: Gene ID:
5789: Symbol: PTPRD: Ensembl_Transcript_ID: ENST00000381196.4: GRCh: 37: Chr: 9:
[Target cancer mutation information]: mut_start: 8518422: mut_end: 8518422: mut_class: Silent:
mut_type: SNP: ref_seq: G: mut_seq: A: mut_aa: p.P323P: mutation info source: CCLE:
ref_target(-10 +10): CTGGAGGTTTGGGTAAGGCTT (SEQ ID NO: 787): mut_target(-10 +10):
CTGGAGGTTTAGGTAAGGCTT (SEQ ID NO: 788): [Model Cell line information]: cell:
NCIH460: cancer_type: LUNG: PAM_dist: 24: indel length: 0: CRISPR gRNA ID: GF-
CCELg12-249: [crRNA sequence]: crRNA sequence: TTTGCTGCTGGATCGTCTCACACACACT
(SEQ ID NO: 791): LbgRNA: AATTCTAATACGACTCACTATAGgtaatttctactaagtgtagat
CTGCTGGATCGTCTCACACACACT (SEQ ID NO: 792): [Target gene information]: Gene ID:
11122: Symbol: PTPRT: Ensembl_Transcript_ID: ENST00000373187.1: GRCh: 37: Chr: 20:
[Target cancer mutation information]: mut_start: 40710604: mut_end: 40710604: mut_class:
Missense_Mutation: mut_type: SNP: ref_seq: A: mut_seq: G: mut_aa: p.M1397T: mutation info
source: CCLE: ref_target(-10 +10): CTGCTGGATCATCTCACACAC (SEQ ID NO: 793):
mut_target(-10 +10): CTGCTGGATCGTCTCACACAC (SEQ ID NO: 794): [Model Cell line
information]: cell: NCIH1563: cancer_type: LUNG: PAM_dist: 11: indel length: 0: CRISPR
gRNA ID: GF-CCELg12-250: [crRNA sequence]: crRNA sequence:
TTTTGCTGCTGGATCGTCTCACACACAC (SEQ ID NO: 795): LbgRNA:
AATTCTAATACGACTCACTATAGgtaatttctactaagtgtagat GCTGCTGGATCGTCTCACACACAC
(SEQ ID NO: 796): [Target gene information]: Gene ID: 11122: Symbol: PTPRT:
Ensembl_Transcript_ID: ENST00000373187.1: GRCh: 37: Chr: 20: [Target cancer mutation
information]: mut_start: 40710604: mut_end: 40710604: mut_class: Missense_Mutation:
mut_type: SNP: ref_seq: A: mut_seq: G: mut_aa: p.M1397T: mutation info source: CCLE:
ref_target(-10 +10): CTGCTGGATCATCTCACACAC (SEQ ID NO: 793): mut_target(-10 +10):
CTGCTGGATCGTCTCACACAC (SEQ ID NO: 794): [Model Cell line information]: cell:
NCIH1563: cancer_type: LUNG: PAM_dist: 12: indel length: 0: CRISPR gRNA ID: GF-
CCELg12-251: [crRNA sequence]: crRNA sequence:
TTTAGGGTCTGTGGGGCACAAAGGTGAA (SEQ ID NO: 797): LbgRNA:
AATTCTAATACGACTCACTATAGgtaatttctactaagtgtagat GGGTCTGTGGGGCACAAAGGTGAA
(SEQ ID NO: 798): [Target gene information]: Gene ID: 11122: Symbol: PTPRT:
Ensembl_Transcript_ID: ENST00000373187.1: GRCh: 37: Chr: 20: [Target cancer mutation
information]: mut_start: 40730932: mut_end: 40730932: mut_class: Silent: mut_type: SNP:
ref_seq: G: mut_seq: T: mut_aa: p.L1182L: mutation info source: CCLE: ref_target(-10 +10):
TCACAATGTTGAGGGTCTGTG (SEQ ID NO: 799): mut_target(-10 +10):
TCACAATGTTTAGGGTCTGTG (SEQ ID NO: 800): [Model Cell line information]: cell:
NCIH1573: cancer_type: LUNG: PAM_dist: -1: indel length: 0: CRISPR gRNA ID: GF-
CCELg12-252: [crRNA sequence]: crRNA sequence: TTTGTGCCCCACAGACCCTAAACATTGT
(SEQ ID NO: 801): LbgRNA: AATTCTAATACGACTCACTATAGgtaatttctactaagtgtagat
TGCCCCACAGACCCTAAACATTGT (SEQ ID NO: 802): [Target gene information]: Gene ID:
11122: Symbol: PTPRT: Ensembl_Transcript_ID: ENST00000373187.1: GRCh: 37: Chr: 20:
[Target cancer mutation information]: mut_start: 40730932: mut_end: 40730932: mut_class: Silent:
mut_type: SNP: ref_seq: G: mut_seq: T: mut_aa: p.L1182L: mutation info source: CCLE:
ref_target(-10 +10): TCACAATGTTGAGGGTCTGTG (SEQ ID NO: 799): mut_target(-10 +10):
TCACAATGTTTAGGGTCTGTG (SEQ ID NO: 800): [Model Cell line information]: cell:
NCIH1573: cancer_type: LUNG: PAM_dist: 16: indel length: 0: CRISPR gRNA ID: GF-
CCELg12-253: [crRNA sequence]: crRNA sequence: TTTCATGACTTTGTTCAGCCACTGCCTG
(SEQ ID NO: 803): LbgRNA: AATTCTAATACGACTCACTATAGgtaatttctactaagtgtagat
ATGACTTTGTTCAGCCACTGCCTG (SEQ ID NO: 804): [Target gene information]: Gene ID:
5885: Symbol: RAD21: Ensembl_Transcript_ID: ENST00000297338.2: GRCh: 37: Chr: 8:
[Target cancer mutation information]: mut_start: 117874101: mut_end: 117874101: mut_class:
Missense_Mutation: mut_type: SNP: ref_seq: T: mut_seq: A: mut_aa: p.D118V: mutation info
source: CCLE: ref_target(-10 +10): CAGTGGCTGATCAAAGTCATG (SEQ ID NO: 805):
mut_target(-10 +10): CAGTGGCTGAACAAAGTCATG (SEQ ID NO: 806): [Model Cell line
information]: cell: NCIH460: cancer_type: LUNG: PAM_dist: 10: indel length: 0: CRISPR
gRNA ID: GF-CCELg12-254: [crRNA sequence]: crRNA sequence:
TTTGTTCAGCCACTGCCTGACTTAGAGT (SEQ ID NO: 807): LbgRNA:
AATTCTAATACGACTCACTATAGgtaatttctactaagtgtagat TTCAGCCACTGCCTGACTTAGAGT
(SEQ ID NO: 808): [Target gene information]: Gene ID: 5885: Symbol: RAD21:
Ensembl_Transcript_ID: ENST00000297338.2: GRCh: 37: Chr: 8: [Target cancer mutation
information]: mut_start: 117874101: mut_end: 117874101: mut_class: Missense_Mutation:
mut_type: SNP: ref_seq: T: mut_seq: A: mut_aa: p.D118V: mutation info source: CCLE:
ref_target(-10 +10): CAGTGGCTGATCAAAGTCATG (SEQ ID NO: 805): mut_target(-10 +10):
CAGTGGCTGAACAAAGTCATG (SEQ ID NO: 806): [Model Cell line information]: cell:
NCIH460: cancer_type: LUNG: PAM_dist: 1: indel length: 0: CRISPR gRNA ID: GF-CCELg12-
255: [crRNA sequence]: crRNA sequence: TTTACCTGAAGAATTTCATGACTTTGTT (SEQ ID
NO: 809): LbgRNA: AATTCTAATACGACTCACTATAGgtaatttctactaagtgtagat
CCTGAAGAATTTCATGACTTTGTT (SEQ ID NO: 810): [Target gene information]: Gene ID:
5885: Symbol: RAD21: Ensembl_Transcript_ID: ENST00000297338.2: GRCh: 37: Chr: 8:
[Target cancer mutation information]: mut_start: 117874101: mut_end: 117874101: mut_class:
Missense_Mutation: mut_type: SNP: ref_seq: T: mut_seq: A: mut_aa: p.D118V: mutation info
source: CCLE: ref_target(-10 +10): CAGTGGCTGATCAAAGTCATG (SEQ ID NO: 805):
mut_target(-10 +10): CAGTGGCTGAACAAAGTCATG (SEQ ID NO: 806): [Model Cell line
information]: cell: NCIH460: cancer_type: LUNG: PAM_dist: 23: indel length: 0: CRISPR
gRNA ID: GF-CCELg12-256: [crRNA sequence]: crRNA sequence:
TTTCTTTTTTTTTTTTAATAGCTTTT (SEQ ID NO: 811): LbgRNA:

TABLE 6-continued

Illustrative guide RNA sequences for Cas12 comprising poylpeptide

```
AATTCTAATACGACTCACTATAGgtaatttctactaagtgtagat TTTTTTTTTTTTTAATAGCTTTT
(SEQ ID NO: 812): [Target gene information]: Gene ID: 5885: Symbol: RAD21:
Ensembl_Transcript_ID: ENST00000297338.2: GRCh: 37: Chr: 8: [Target cancer mutation
information]: mut_start: 117864945: mut_end: 117864945: mut_class: Silent: mut_type: SNP:
ref_seq: G: mut_seq: A: mut_aa: p.L388L: mutation info source: CCLE: ref_target(-10 +10):
AGCGTGTAAAGAGCTATTAAA (SEQ ID NO: 813): mut_target(-10 +10):
AGCGTGTAAAAAGCTATTAAA (SEQ ID NO: 814): [Model Cell line information]: cell:
NCIH1563: cancer_type: LUNG: PAM_dist: 22: indel length: 0: CRISPR gRNA ID: GF-
CCELg12-257: [crRNA sequence]: crRNA sequence: TTTAATAGCTTTTTACACGCTGTCTTAC
(SEQ ID NO: 815): LbgRNA: AATTCTAATACGACTCACTATAGgtaatttctactaagtgtagat
ATAGCTTTTTACACGCTGTCTTAC (SEQ ID NO: 816): [Target gene information]: Gene ID:
5885: Symbol: RAD21: Ensembl_Transcript_ID: ENST00000297338.2: GRCh: 37: Chr: 8:
[Target cancer mutation information]: mut_start: 117864945: mut_end: 117864945: mut_class:
Silent: mut_type: SNP: ref_seq: G: mut_seq: A: mut_aa: p.L388L: mutation info source: CCLE:
ref_target(-10 +10): AGCGTGTAAAGAGCTATTAAA (SEQ ID NO: 813): mut_target(-10 +10):
AGCGTGTAAAAAGCTATTAAA (SEQ ID NO: 814): [Model Cell line information]: cell:
NCIH1563: cancer_type: LUNG: PAM_dist: 7: indel length: 0: CRISPR gRNA ID: GF-
CCELg12-258: [crRNA sequence]: crRNA sequence: TTTTTCTTTTTTTTTTTTAATAGCTT
(SEQ ID NO: 817): LbgRNA: AATTCTAATACGACTCACTATAGgtaatttctactaagtgtagat
TCTTTTTTTTTTTTTAATAGCTT (SEQ ID NO: 818): [Target gene information]: Gene ID: 5885:
Symbol: RAD21: Ensembl_Transcript_ID: ENST00000297338.2: GRCh: 37: Chr: 8: [Target
cancer mutation information]: mut_start: 117864945: mut_end: 117864945: mut_class: Silent:
mut_type: SNP: ref_seq: G: mut_seq: A: mut_aa: p.L388L: mutation info source: CCLE:
ref_target(-10 +10): AGCGTGTAAAGAGCTATTAAA (SEQ ID NO: 813): mut_target(-10 +10):
AGCGTGTAAAAAGCTATTAAA (SEQ ID NO: 814): [Model Cell line information]: cell:
NCIH1563: cancer_type: LUNG: PAM_dist: 24: indel length: 0: CRISPR gRNA ID: GF-
CCELg12-259: [crRNA sequence]: crRNA sequence: TTTTCTTTTTTTTTTTAATAGCTTT
(SEQ ID NO: 819): LbgRNA: AATTCTAATACGACTCACTATAGgtaatttctactaagtgtagat
CTTTTTTTTTTTTTAATAGCTTT (SEQ ID NO: 820): [Target gene information]: Gene ID: 5885:
Symbol: RAD21: Ensembl_Transcript_ID: ENST00000297338.2: GRCh: 37: Chr: 8: [Target
cancer mutation information]: mut_start: 117864945: mut_end: 117864945: mut_class: Silent:
mut_type: SNP: ref_seq: G: mut_seq: A: mut_aa: p.L388L: mutation info source: CCLE:
ref_target(-10 +10): AGCGTGTAAAGAGCTATTAAA (SEQ ID NO: 813): mut_target(-10 +10):
AGCGTGTAAAAAGCTATTAAA (SEQ ID NO: 814): [Model Cell line information]: cell:
NCIH1563: cancer_type: LUNG: PAM_dist: 23: indel length: 0: CRISPR gRNA ID: GF-
CCELg12-260: [crRNA sequence]: crRNA sequence: TTTTTTTTTTTTAATAGCTTTTTACA
(SEQ ID NO: 821): LbgRNA: AATTCTAATACGACTCACTATAGgtaatttctactaagtgtagat
TTTTTTTTTAATAGCTTTTTACA (SEQ ID NO: 822): [Target gene information]: Gene ID:
5885: Symbol: RAD21: Ensembl_Transcript_ID: ENST00000297338.2: GRCh: 37: Chr: 8:
[Target cancer mutation information]: mut_start: 117864945: mut_end: 117864945: mut_class:
Silent: mut_type: SNP: ref_seq: G: mut_seq: A: mut_aa: p.L388L: mutation info source: CCLE:
ref_target(-10 +10): AGCGTGTAAAGAGCTATTAAA (SEQ ID NO: 813): mut_target(-10 +10):
AGCGTGTAAAAAGCTATTAAA (SEQ ID NO: 814): [Model Cell line information]: cell:
NCIH1563: cancer_type: LUNG: PAM_dist: 18: indel length: 0: CRISPR gRNA ID: GF-
CCELg12-261: [crRNA sequence]: crRNA sequence: TTTTTTTTTTTAATAGCTTTTTACAC
(SEQ ID NO: 823): LbgRNA: AATTCTAATACGACTCACTATAGgtaatttctactaagtgtagat
TTTTTTTTAATAGCTTTTTACAC (SEQ ID NO: 824): [Target gene information]: Gene ID:
5885: Symbol: RAD21: Ensembl_Transcript_ID: ENST00000297338.2: GRCh: 37: Chr: 8:
[Target cancer mutation information]: mut_start: 117864945: mut_end: 117864945: mut_class:
Silent: mut_type: SNP: ref_seq: G: mut_seq: A: mut_aa: p.L388L: mutation info source: CCLE:
ref_target(-10 +10): AGCGTGTAAAGAGCTATTAAA (SEQ ID NO: 813): mut_target(-10 +10):
AGCGTGTAAAAAGCTATTAAA (SEQ ID NO: 814): [Model Cell line information]: cell:
NCIH1563: cancer_type: LUNG: PAM_dist: 17: indel length: 0: CRISPR gRNA ID: GF-
CCELg12-262: [crRNA sequence]: crRNA sequence: TTTTTTTTTTAATAGCTTTTTACACG
(SEQ ID NO: 825): LbgRNA: AATTCTAATACGACTCACTATAGgtaatttctactaagtgtagat
TTTTTTAATAGCTTTTTACACG (SEQ ID NO: 826): [Target gene information]: Gene ID:
5885: Symbol: RAD21: Ensembl_Transcript_ID: ENST00000297338.2: GRCh: 37: Chr: 8:
[Target cancer mutation information]: mut_start: 117864945: mut_end: 117864945: mut_class:
Silent: mut_type: SNP: ref_seq: G: mut_seq: A: mut_aa: p.L388L: mutation info source: CCLE:
ref_target(-10 +10): AGCGTGTAAAGAGCTATTAAA (SEQ ID NO: 813): mut_target(-10 +10):
AGCGTGTAAAAAGCTATTAAA (SEQ ID NO: 814): [Model Cell line information]: cell:
NCIH1563: cancer_type: LUNG: PAM_dist: 16: indel length: 0: CRISPR gRNA ID: GF-
CCELg12-263: [crRNA sequence]: crRNA sequence: TTTTTTTTTAATAGCTTTTTACACGC
(SEQ ID NO: 827): LbgRNA: AATTCTAATACGACTCACTATAGgtaatttctactaagtgtagat
TTTTTAATAGCTTTTTACACGC (SEQ ID NO: 828): [Target gene information]: Gene ID:
5885: Symbol: RAD21: Ensembl_Transcript_ID: ENST00000297338.2: GRCh: 37: Chr: 8:
[Target cancer mutation information]: mut_start: 117864945: mut_end: 117864945: mut_class:
Silent: mut_type: SNP: ref_seq: G: mut_seq: A: mut_aa: p.L388L: mutation info source: CCLE:
ref_target(-10 +10): AGCGTGTAAAGAGCTATTAAA (SEQ ID NO: 813): mut_target(-10 +10):
AGCGTGTAAAAAGCTATTAAA (SEQ ID NO: 814): [Model Cell line information]: cell:
NCIH1563: cancer_type: LUNG: PAM_dist: 15: indel length: 0: CRISPR gRNA ID: GF-
CCELg12-264: [crRNA sequence]: crRNA sequence: TTTTTTTTAATAGCTTTTTACACGCT
(SEQ ID NO: 829): LbgRNA: AATTCTAATACGACTCACTATAGgtaatttctactaagtgtagat
TTTTTAATAGCTTTTTACACGCT (SEQ ID NO: 830): [Target gene information]: Gene ID:
5885: Symbol: RAD21: Ensembl_Transcript_ID: ENST00000297338.2: GRCh: 37: Chr: 8:
[Target cancer mutation information]: mut_start: 117864945: mut_end: 117864945: mut_class:
Silent: mut_type: SNP: ref_seq: G: mut_seq: A: mut_aa: p.L388L: mutation info source: CCLE:
ref_target(-10 +10): AGCGTGTAAAGAGCTATTAAA (SEQ ID NO: 813): mut_target(-10 +10):
```

TABLE 6-continued

Illustrative guide RNA sequences for Cas12 comprising poylpeptide

AGCGTGTAAAAAGCTATTAAA (SEQ ID NO: 814): [Model Cell line information]: cell:
NCIH1563: cancer_type: LUNG: PAM_dist: 14: indel length: 0: CRISPR gRNA ID: GF-
CCELg12-265: [crRNA sequence]: crRNA sequence: TTTTTTTTAATAGCTTTTTACACGCTG
(SEQ ID NO: 831): LbgRNA: AATTCTAATACGACTCACTATAGgtaatttctactaagtgtagat
TTTTTAATAGCTTTTTACACGCTG (SEQ ID NO: 832): [Target gene information]: Gene ID:
5885: Symbol: RAD21: Ensembl_Transcript_ID: ENST00000297338.2: GRCh: 37: Chr: 8:
[Target cancer mutation information]: mut_start: 117864945: mut_end: 117864945: mut_class:
Silent: mut_type: SNP: ref_seq: G: mut_seq: A: mut_aa: p.L388L: mutation info source: CCLE:
ref_target(−10 +10): AGCGTGTAAAGAGCTATTAAA (SEQ ID NO: 813): mut_target(−10 +10):
AGCGTGTAAAAAGCTATTAAA (SEQ ID NO: 814): [Model Cell line information]: cell:
NCIH1563: cancer_type: LUNG: PAM_dist: 13: indel length: 0: CRISPR gRNA ID: GF-
CCELg12-266: [crRNA sequence]: crRNA sequence: TTTTTTTTAATAGCTTTTTACACGCTGT
(SEQ ID NO: 833): LbgRNA: AATTCTAATACGACTCACTATAGgtaatttctactaagtgtagat
TTTTAATAGCTTTTTACACGCTGT (SEQ ID NO: 834): [Target gene information]: Gene ID:
5885: Symbol: RAD21: Ensembl_Transcript_ID: ENST00000297338.2: GRCh: 37: Chr: 8:
[Target cancer mutation information]: mut_start: 117864945: mut_end: 117864945: mut_class:
Silent: mut_type: SNP: ref_seq: G: mut_seq: A: mut_aa: p.L388L: mutation info source: CCLE:
ref_target(−10 +10): AGCGTGTAAAGAGCTATTAAA (SEQ ID NO: 813): mut_target(−10 +10):
AGCGTGTAAAAAGCTATTAAA (SEQ ID NO: 814): [Model Cell line information]: cell:
NCIH1563: cancer_type: LUNG: PAM_dist: 12: indel length: 0: CRISPR gRNA ID: GF-
CCELg12-267: [crRNA sequence]: crRNA sequence: TTTTTTTAATAGCTTTTTACACGCTGTC
(SEQ ID NO: 835): LbgRNA: AATTCTAATACGACTCACTATAGgtaatttctactaagtgtagat
TTTAATAGCTTTTTACACGCTGTC (SEQ ID NO: 836): [Target gene information]: Gene ID:
5885: Symbol: RAD21: Ensembl_Transcript_ID: ENST00000297338.2: GRCh: 37: Chr: 8:
[Target cancer mutation information]: mut_start: 117864945: mut_end: 117864945: mut_class:
Silent: mut_type: SNP: ref_seq: G: mut_seq: A: mut_aa: p.L388L: mutation info source: CCLE:
ref_target(−10 +10): AGCGTGTAAAGAGCTATTAAA (SEQ ID NO: 813): mut_target(−10 +10):
AGCGTGTAAAAAGCTATTAAA (SEQ ID NO: 814): [Model Cell line information]: cell:
NCIH1563: cancer_type: LUNG: PAM_dist: 11: indel length: 0: CRISPR gRNA ID: GF-
CCELg12-268: [crRNA sequence]: crRNA sequence: TTTTTAATAGCTTTTTACACGCTGTCT
(SEQ ID NO: 837): LbgRNA: AATTCTAATACGACTCACTATAGgtaatttctactaagtgtagat
TTAATAGCTTTTTACACGCTGTCT (SEQ ID NO: 838): [Target gene information]: Gene ID:
5885: Symbol: RAD21: Ensembl_Transcript_ID: ENST00000297338.2: GRCh: 37: Chr: 8:
[Target cancer mutation information]: mut_start: 117864945: mut_end: 117864945: mut_class:
Silent: mut_type: SNP: ref_seq: G: mut_seq: A: mut_aa: p.L388L: mutation info source: CCLE:
ref_target(−10 +10): AGCGTGTAAAGAGCTATTAAA (SEQ ID NO: 813): mut_target(−10 +10):
AGCGTGTAAAAAGCTATTAAA (SEQ ID NO: 814): [Model Cell line information]: cell:
NCIH1563: cancer_type: LUNG: PAM_dist: 10: indel length: 0: CRISPR gRNA ID: GF-
CCELg12-269: [crRNA sequence]: crRNA sequence: TTTTTAATAGCTTTTTACACGCTGTCTT
(SEQ ID NO: 839): LbgRNA: AATTCTAATACGACTCACTATAGgtaatttctactaagtgtagat
TAATAGCTTTTTACACGCTGTCTT (SEQ ID NO: 840): [Target gene information]: Gene ID:
5885: Symbol: RAD21: Ensembl_Transcript_ID: ENST00000297338.2: GRCh: 37: Chr: 8:
[Target cancer mutation information]: mut_start: 117864945: mut_end: 117864945: mut_class:
Silent: mut_type: SNP: ref_seq: G: mut_seq: A: mut_aa: p.L388L: mutation info source: CCLE:
ref_target(−10 +10): AGCGTGTAAAGAGCTATTAAA (SEQ ID NO: 813): mut_target(−10 +10):
AGCGTGTAAAAAGCTATTAAA (SEQ ID NO: 814): [Model Cell line information]: cell:
NCIH1563: cancer_type: LUNG: PAM_dist: 9: indel length: 0: CRISPR gRNA ID: GF-
CCELg12-270: [crRNA sequence]: crRNA sequence: TTTTAATAGCTTTTTACACGCTGTCTTA
(SEQ ID NO: 841): LbgRNA: AATTCTAATACGACTCACTATAGgtaatttctactaagtgtagat
AATAGCTTTTTACACGCTGTCTTA (SEQ ID NO: 842): [Target gene information]: Gene ID:
5885: Symbol: RAD21: Ensembl_Transcript_ID: ENST00000297338.2: GRCh: 37: Chr: 8:
[Target cancer mutation information]: mut_start: 117864945: mut_end: 117864945: mut_class:
Silent: mut_type: SNP: ref_seq: G: mut_seq: A: mut_aa: p.L388L: mutation info source: CCLE:
ref_target(−10 +10): AGCGTGTAAAGAGCTATTAAA (SEQ ID NO: 813): mut_target(−10 +10):
AGCGTGTAAAAAGCTATTAAA (SEQ ID NO: 814): [Model Cell line information]: cell:
NCIH1563: cancer_type: LUNG: PAM_dist: 8: indel length: 0: CRISPR gRNA ID: GF-
CCELg12-271: [crRNA sequence]: crRNA sequence: TTTTTACACGCTGTCTTACACCGCTTGT
(SEQ ID NO: 843): LbgRNA: AATTCTAATACGACTCACTATAGgtaatttctactaagtgtagat
TACACGCTGTCTTACACCGCTTGT (SEQ ID NO: 844): [Target gene information]: Gene ID:
5885: Symbol: RAD21: Ensembl_Transcript_ID: ENST00000297338.2: GRCh: 37: Chr: 8:
[Target cancer mutation information]: mut_start: 117864945: mut_end: 117864945: mut_class:
Silent: mut_type: SNP: ref_seq: G: mut_seq: A: mut_aa: p.L388L: mutation info source: CCLE:
ref_target(−10 +10): AGCGTGTAAAGAGCTATTAAA (SEQ ID NO: 813): mut_target(−10 +10):
AGCGTGTAAAAAGCTATTAAA (SEQ ID NO: 814): [Model Cell line information]: cell:
NCIH1563: cancer_type: LUNG: PAM_dist: −2: indel length: 0: CRISPR gRNA ID: GF-
CCELg12-272: [crRNA sequence]: crRNA sequence: TTTTACACGCTGTCTTACACCGCTTGTA
(SEQ ID NO: 845): LbgRNA: AATTCTAATACGACTCACTATAGgtaatttctactaagtgtagat
ACACGCTGTCTTACACCGCTTGTA (SEQ ID NO: 846): [Target gene information]: Gene ID:
5885: Symbol: RAD21: Ensembl_Transcript_ID: ENST00000297338.2: GRCh: 37: Chr: 8:
[Target cancer mutation information]: mut_start: 117864945: mut_end: 117864945: mut_class:
Silent: mut_type: SNP: ref_seq: G: mut_seq: A: mut_aa: p.L388L: mutation info source: CCLE:
ref_target(−10 +10): AGCGTGTAAAGAGCTATTAAA (SEQ ID NO: 813): mut_target(−10 +10):
AGCGTGTAAAAAGCTATTAAA (SEQ ID NO: 814): [Model Cell line information]: cell:
NCIH1563: cancer_type: LUNG: PAM_dist: −3: indel length: 0: CRISPR gRNA ID: GF-
CCELg12-273: [crRNA sequence]: crRNA sequence:

TABLE 6-continued

Illustrative guide RNA sequences for Cas12 comprising poylpeptide

TTTCCAAGAACCAAGCTCTTCCGAGGGA (SEQ ID NO: 847): LbgRNA:
AATTCTAATACGACTCACTATAGgtaatttctactaagtgtagat CAAGAACCAAGCTCTTCCGAGGGA
(SEQ ID NO: 848): [Target gene information]: Gene ID: 5979: Symbol: RET:
Ensembl_Transcript_ID: ENST00000355710.3: GRCh: 37: Chr: 10: [Target cancer mutation
information]: mut_start: 43612063: mut_end: 43612063: mut_class: Missense_Mutation:
mut_type: SNP: ref_seq: A: mut_seq: G: mut_aa: p.N723S: mutation info source: CCLE:
ref_target(-10 +10) CCTCGGAAGAACTTGGTTCTT (SEQ ID NO: 849): mut_target(-10 +10):
CCTCGGAAGAGCTTGGTTCTT (SEQ ID NO: 850): [Model Cell line information]: cell:
HCC827GR5: cancer_type: LUNG: PAM_dist: 12: indel length: 0: CRISPR gRNA ID: GF-
CCELg12-274: [crRNA sequence]: crRNA sequence:
TTTTTCCAAGAACCAAGCTCTTCCGAGG (SEQ ID NO: 851): LbgRNA:
AATTCTAATACGACTCACTATAGgtaatttctactaagtgtagat TCCAAGAACCAAGCTCTTCCGAGG
(SEQ ID NO: 852): [Target gene information]: Gene ID: 5979: Symbol: RET:
Ensembl_Transcript_ID: ENST00000355710.3: GRCh: 37: Chr: 10: [Target cancer mutation
information]: mut_start: 43612063: mut_end: 43612063: mut_class: Missense_Mutation:
mut_type: SNP: ref_seq: A: mut_seq: G: mut_aa: p.N723S: mutation info source: CCLE:
ref_target(-10 +10) CCTCGGAAGAACTTGGTTCTT (SEQ ID NO: 849): mut_target(-10 +10):
CCTCGGAAGAGCTTGGTTCTT (SEQ ID NO: 850): [Model Cell line information]: cell:
HCC827GR5: cancer_type: LUNG: PAM_dist: 14: indel length: 0: CRISPR gRNA ID: GF-
CCELg12-275: [crRNA sequence]: crRNA sequence:
TTTTCCAAGAACCAAGCTCTTCCGAGGG (SEQ ID NO: 853): LbgRNA:
AATTCTAATACGACTCACTATAGgtaatttctactaagtgtagat CCAAGAACCAAGCTCTTCCGAGGG
(SEQ ID NO: 854): [Target gene information]: Gene ID: 5979: Symbol: RET:
Ensembl_Transcript_ID: ENST00000355710.3: GRCh: 37: Chr: 10: [Target cancer mutation
information]: mut_start: 43612063: mut_end: 43612063: mut_class: Missense_Mutation:
mut_type: SNP: ref_seq: A: mut_seq: G: mut_aa: p.N723S: mutation info source: CCLE:
ref_target(-10 +10) CCTCGGAAGAACTTGGTTCTT (SEQ ID NO: 849): mut_target(-10 +10):
CCTCGGAAGAGCTTGGTTCTT (SEQ ID NO: 850): [Model Cell line information]: cell:
HCC827GR5: cancer_type: LUNG: PAM_dist: 13: indel length: 0: CRISPR gRNA ID: GF-
CCELg12-276: [crRNA sequence]: crRNA sequence: TTTGGTTCTTGTACACAAACTACATCAG
(SEQ ID NO: 855): LbgRNA: AATTCTAATACGACTCACTATAGgtaatttctactaagtgtagat
GTTCTTGTACACAAACTACATCAG (SEQ ID NO: 856): [Target gene information]: Gene ID:
54894: Symbol: RNF43: Ensembl_Transcript_ID: ENST00000584437.1: GRCh: 37: Chr: 17:
[Target cancer mutation information]: mut_start: 56440698: mut_end: 56440698: mut_class:
Nonsense_Mutation: mut_type: SNP: ref_seq: C: mut_seq: A: mut_aa: p.E174*: mutation info
source: CCLE: ref_target(-10 +10): TACACAAACTCCATCAGCTTC (SEQ ID NO: 857):
mut_target(-10 +10): TACACAAACTACATCAGCTTC (SEQ ID NO: 858): [Model Cell line
information]: cell: HPAFII: cancer_type: PANCREAS: PAM_dist: 18: indel length: 0: CRISPR
gRNA ID: GF-CCELg12-277: [crRNA sequence]: crRNA sequence:
TTTTGGTTCTTGTACACAAACTACATCA (SEQ ID NO: 859): LbgRNA:
AATTCTAATACGACTCACTATAGgtaatttctactaagtgtagat GGTTCTTGTACACAAACTACATCA
(SEQ ID NO: 860): [Target gene information]: Gene ID: 54894: Symbol: RNF43:
Ensembl_Transcript_ID: ENST00000584437.1: GRCh: 37: Chr: 17: [Target cancer mutation
information]: mut_start: 56440698: mut_end: 56440698: mut_class: Nonsense_Mutation:
mut_type: SNP: ref_seq: C: mut_seq: A: mut_aa: p.E174*: mutation info source: CCLE:
ref_target(-10 +10): TACACAAACTCCATCAGCTTC (SEQ ID NO: 857): mut_target(-10 +10):
TACACAAACTACATCAGCTTC (SEQ ID NO: 858): [Model Cell line information]: cell: HPAFII:
cancer_type: PANCREAS: PAM_dist: 19: indel length: 0: CRISPR gRNA ID: GF-CCELg12-
278: [crRNA sequence]: crRNA sequence: TTTCTTCTTATTTTAGATAAATCGTTTC (SEQ ID
NO: 861): LbgRNA: AATTCTAATACGACTCACTATAGgtaatttctactaagtgtagat
TTCTTATTTTAGATAAATCGTTTC (SEQ ID NO: 862): [Target gene information]: Gene ID:
6098: Symbol: ROS1: Ensembl_Transcript_ID: ENST00000368508.3: GRCh: 37: Chr: 6:
[Target cancer mutation information]: mut_start: 117665420: mut_end: 117665420: mut_class:
Missense_Mutation: mut_type: SNP: ref_seq: C: mut_seq: A: mut_aa: p.A1443S: mutation info
source: CCLE: ref_target(-10 +10): GACAGAAACGCTTTATCTAAA (SEQ ID NO: 863):
mut_target(-10 +10): GACAGAAACGATTTATCTAAA (SEQ ID NO: 864): [Model Cell line
information]: cell: NCIH661: cancer_type: LUNG: PAM_dist: 18: indel length: 0: CRISPR
gRNA ID: GF-CCELg12-279: [crRNA sequence]: crRNA sequence:
TTTGGTTTCTTCTTATTTTAGATAAATC (SEQ ID NO: 865): LbgRNA:
AATTCTAATACGACTCACTATAGgtaatttctactaagtgtagat GTTTCTTCTTATTTTAGATAAATC
(SEQ ID NO: 866): [Target gene information]: Gene ID: 6098: Symbol: ROS1:
Ensembl_Transcript_ID: ENST00000368508.3: GRCh: 37: Chr: 6: [Target cancer mutation
information]: mut_start: 117665420: mut_end: 117665420: mut_class: Missense_Mutation:
mut_type: SNP: ref_seq: C: mut_seq: A: mut_aa: p.A1443S: mutation info source: CCLE:
ref_target(-10 +10): GACAGAAACGCTTTATCTAAA (SEQ ID NO: 863): mut_target(-10 +10):
GACAGAAACGATTTATCTAAA (SEQ ID NO: 864): [Model Cell line information]: cell:
NCIH661: cancer_type: LUNG: PAM_dist: 23: indel length: 0: CRISPR gRNA ID: GF-
CCELg12-280: [crRNA sequence]: crRNA sequence: TTTAGATAAATCGTTTCTGTCTCTAGCT
(SEQ ID NO: 867): LbgRNA: AATTCTAATACGACTCACTATAGgtaatttctactaagtgtagat
GATAAATCGTTTCTGTCTCTAGCT (SEQ ID NO: 868): [Target gene information]: Gene ID:
6098: Symbol: ROS1: Ensembl_Transcript_ID: ENST00000368508.3: GRCh: 37: Chr: 6:
[Target cancer mutation information]: mut_start: 117665420: mut_end: 117665420: mut_class:
Missense_Mutation: mut_type: SNP: ref_seq: C: mut_seq: A: mut_aa: p.A1443S: mutation info
source: CCLE: ref_target(-10 +10): GACAGAAACGCTTTATCTAAA (SEQ ID NO: 863):
mut_target(-10 +10): GACAGAAACGATTTATCTAAA (SEQ ID NO: 864): [Model Cell line
information]: cell: NCIH661: cancer_type: LUNG: PAM_dist: 7: indel length: 0: CRISPR gRNA
ID: GF-CCELg12-281: [crRNA sequence]: crRNA sequence:
TTTTGGTTTCTTCTTATTTTAGATAAAT (SEQ ID NO: 869): LbgRNA:

TABLE 6-continued

Illustrative guide RNA sequences for Cas12 comprising poylpeptide

```
AATTCTAATACGACTCACTATAGgtaatttctactaagtgtagat GGTTTCTTCTTATTTTAGATAAAT
(SEQ ID NO: 870): [Target gene information]: Gene ID: 6098: Symbol: ROS1:
Ensembl_Transcript_ID: ENST00000368508.3: GRCh: 37: Chr: 6: [Target cancer mutation
information]: mut_start: 117665420: mut_end: 117665420: mut_class: Missense_Mutation:
mut_type: SNP: ref_seq: C: mut_seq: A: mut_aa: p.A1443S: mutation info source: CCLE:
ref_target(-10 +10): GACAGAAACGCTTTATCTAAA (SEQ ID NO: 863): mut_target(-10 +10):
GACAGAAACGATTTATCTAAA (SEQ ID NO: 864): [Model Cell line information]: cell:
NCIH661: cancer_type: LUNG: PAM_dist: 24: indel length: 0: CRISPR gRNA ID: GF-
CCELg12-282: [crRNA sequence]: crRNA sequence: TTTTAGATAAATCGTTTCTGTCTCTAGC
(SEQ ID NO: 871): LbgRNA: AATTCTAATACGACTCACTATAGgtaatttctactaagtgtagat
AGATAAATCGTTTCTGTCTCTAGC (SEQ ID NO: 872): [Target gene information]: Gene ID:
6098: Symbol: ROS1: Ensembl_Transcript_ID: ENST00000368508.3: GRCh: 37: Chr: 6:
[Target cancer mutation information]: mut_start: 117665420: mut_end: 117665420: mut_class:
Missense_Mutation: mut_type: SNP: ref_seq: C: mut_seq: A: mut_aa: p.A1443S: mutation info
source: CCLE: ref_target(-10 +10): GACAGAAACGCTTTATCTAAA (SEQ ID NO: 863):
mut_target(-10 +10): GACAGAAACGATTTATCTAAA (SEQ ID NO: 864): [Model Cell line
information]: cell: NCIH661: cancer_type: LUNG: PAM_dist: 8: indel length: 0: CRISPR gRNA
ID: GF-CCELg12-283: [crRNA sequence]: crRNA sequence:
TTTCTTGTTGGTATTTTTGTTGGTAACA (SEQ ID NO: 873): LbgRNA:
AATTCTAATACGACTCACTATAGgtaatttctactaagtgtagat TTGTTGGTATTTTTGTTGGTAACA
(SEQ ID NO: 874): [Target gene information]: Gene ID: 23429: Symbol: RYBP:
Ensembl_Transcript_ID: ENST00000477973.2: GRCh: 37: Chr: 3: [Target cancer mutation
information]: mut_start: 72428425: mut_end: 72428425: mut_class: Missense_Mutation:
mut_type: SNP: ref_seq: C: mut_seq: G: mut_aa: p.E193Q: mutation info source: CCLE:
ref_target(-10 +10): TGGTATTTTTCTTGGTAACAC (SEQ ID NO: 875): mut_target(-10 +10):
TGGTATTTTTGTTGGTAACAC (SEQ ID NO: 876): [Model Cell line information]: cell:
NCIH1563: cancer_type: LUNG: PAM_dist: 15: indel length: 0: CRISPR gRNA ID: GF-
CCELg12-284: [crRNA sequence]: crRNA sequence: TTTGTTGGTAACACTAGGACTAATTTCC
(SEQ ID NO: 877): LbgRNA: AATTCTAATACGACTCACTATAGgtaatttctactaagtgtagat
TTGGTAACACTAGGACTAATTTCC (SEQ ID NO: 878): [Target gene information]: Gene ID:
23429: Symbol: RYBP: Ensembl_Transcript_ID: ENST00000477973.2: GRCh: 37: Chr: 3:
[Target cancer mutation information]: mut_start: 72428425: mut_end: 72428425: mut_class:
Missense_Mutation: mut_type: SNP: ref_seq: C: mut_seq: G: mut_aa: p.E193Q: mutation info
source: CCLE: ref_target(-10 +10): TGGTATTTTTCTTGGTAACAC (SEQ ID NO: 875):
mut_target(-10 +10): TGGTATTTTTGTTGGTAACAC (SEQ ID NO: 876): [Model Cell line
information]: cell: NCIH1563: cancer_type: LUNG: PAM_dist: 0: indel length: 0: CRISPR
gRNA ID: GF-CCELg12-285: [crRNA sequence]: crRNA sequence:
TTTTCTTGTTGGTATTTTTGTTGGTAAC (SEQ ID NO: 879): LbgRNA:
AATTCTAATACGACTCACTATAGgtaatttctactaagtgtagat CTTGTTGGTATTTTTGTTGGTAAC
(SEQ ID NO: 880): [Target gene information]: Gene ID: 23429: Symbol: RYBP:
Ensembl_Transcript_ID: ENST00000477973.2: GRCh: 37: Chr: 3: [Target cancer mutation
information]: mut_start: 72428425: mut_end: 72428425: mut_class: Missense_Mutation:
mut_type: SNP: ref_seq: C: mut_seq: G: mut_aa: p.E193Q: mutation info source: CCLE:
ref_target(-10 +10): TGGTATTTTTCTTGGTAACAC (SEQ ID NO: 875): mut_target(-10 +10):
TGGTATTTTTGTTGGTAACAC (SEQ ID NO: 876): [Model Cell line information]: cell:
NCIH1563: cancer_type: LUNG: PAM_dist: 16: indel length: 0: CRISPR gRNA ID: GF-
CCELg12-286: [crRNA sequence]: crRNA sequence: TTTTTGTTGGTAACACTAGGACTAATTT
(SEQ ID NO: 881): LbgRNA: AATTCTAATACGACTCACTATAGgtaatttctactaagtgtagat
TGTTGGTAACACTAGGACTAATTT (SEQ ID NO: 882): [Target gene information]: Gene ID:
23429: Symbol: RYBP: Ensembl_Transcript_ID: ENST00000477973.2: GRCh: 37: Chr: 3:
[Target cancer mutation information]: mut_start: 72428425: mut_end: 72428425: mut_class:
Missense_Mutation: mut_type: SNP: ref_seq: C: mut_seq: G: mut_aa: p.E193Q: mutation info
source: CCLE: ref_target(-10 +10): TGGTATTTTTCTTGGTAACAC (SEQ ID NO: 875):
mut_target(-10 +10): TGGTATTTTTGTTGGTAACAC (SEQ ID NO: 876): [Model Cell line
information]: cell: NCIH1563: cancer_type: LUNG: PAM_dist: 2: indel length: 0: CRISPR
gRNA ID: GF-CCELg12-287: [crRNA sequence]: crRNA sequence:
TTTTGTTGGTAACACTAGGACTAATTTC (SEQ ID NO: 883): LbgRNA:
AATTCTAATACGACTCACTATAGgtaatttctactaagtgtagat GTTGGTAACACTAGGACTAATTTC
(SEQ ID NO: 884): [Target gene information]: Gene ID: 23429: Symbol: RYBP:
Ensembl_Transcript_ID: ENST00000477973.2: GRCh: 37: Chr: 3: [Target cancer mutation
information]: mut_start: 72428425: mut_end: 72428425: mut_class: Missense_Mutation:
mut_type: SNP: ref_seq: C: mut_seq: G: mut_aa: p.E193Q: mutation info source: CCLE:
ref_target(-10 +10): TGGTATTTTTCTTGGTAACAC (SEQ ID NO: 875): mut_target(-10 +10):
TGGTATTTTTGTTGGTAACAC (SEQ ID NO: 876): [Model Cell line information]: cell:
NCIH1563: cancer_type: LUNG: PAM_dist: 1: indel length: 0: CRISPR gRNA ID: GF-
CCELg12-288: [crRNA sequence]: crRNA sequence: TTTCTTTATGGGCTTTCAGGCAGACAT
(SEQ ID NO: 885): LbgRNA: AATTCTAATACGACTCACTATAGgtaatttctactaagtgtagat
TTTATGGGCTTTCAGGCAGACAT (SEQ ID NO: 886): [Target gene information]: Gene ID:
4068: Symbol: SH2D1A: Ensembl_Transcript_ID: ENST00000371139.4: GRCh: 37: Chr: X:
[Target cancer mutation information]: mut_start: 123505240: mut_end: 123505240: mut_class:
Silent: mut_type: SNP: ref_seq: G: mut_seq: A: mut_aa: p.*129*: mutation info source: CCLE:
ref_target(-10 +10): AAAGCCCCATGAAGAAAAATA (SEQ ID NO: 887): mut_target(-10 +10):
AAAGCCCCATAAAGAAAAATA (SEQ ID NO: 888): [Model Cell line information]: cell:
NCIH661: cancer_type: LUNG: PAM_dist: 3: indel length: 0: CRISPR gRNA ID: GF-CCELg12-
289: [crRNA sequence]: crRNA sequence: TTTATTTTTCTTTATGGGCTTTCAGGC (SEQ ID
NO: 889): LbgRNA: AATTCTAATACGACTCACTATAGgtaatttctactaagtgtagat
TTTTTCTTTATGGGCTTTCAGGC (SEQ ID NO: 890): [Target gene information]: Gene ID:
4068: Symbol: SH2D1A: Ensembl_Transcript_ID: ENST00000371139.4: GRCh: 37: Chr: X:
```

TABLE 6-continued

Illustrative guide RNA sequences for Cas12 comprising poylpeptide

[Target cancer mutation information]: mut_start: 123505240: mut_end: 123505240: mut_class:
Silent: mut_type: SNP: ref_seq: G: mut_seq: A: mut_aa: p.*129*: mutation info source: CCLE:
ref_target(-10 +10): AAAGCCCCATGAAGAAAAATA (SEQ ID NO: 887): mut_target(-10 +10):
AAAGCCCCATAAAGAAAAATA (SEQ ID NO: 888): [Model Cell line information]: cell:
NCIH661: cancer_type: LUNG: PAM_dist: 9: indel length: 0: CRISPR gRNA ID: GF-CCELg12-
290: [crRNA sequence]: crRNA sequence: TTTATGGGGCTTTCAGGCAGACATCAGG (SEQ ID
NO: 891): LbgRNA: AATTCTAATACGACTCACTATAGgtaatttctactaagtgtagat
TGGGGCTTTCAGGCAGACATCAGG (SEQ ID NO: 892): [Target gene information]: Gene ID:
4068: Symbol: SH2D1A: Ensembl_Transcript_ID: ENST00000371139.4: GRCh: 37: Chr: X:
[Target cancer mutation information]: mut_start: 123505240: mut_end: 123505240: mut_class:
Silent: mut_type: SNP: ref_seq: G: mut_seq: A: mut_aa: p.*129*: mutation info source: CCLE:
ref_target(-10 +10): AAAGCCCCATGAAGAAAAATA (SEQ ID NO: 887): mut_target(-10 +10):
AAAGCCCCATAAAGAAAAATA (SEQ ID NO: 888): [Model Cell line information]: cell:
NCIH661: cancer_type: LUNG: PAM_dist: -1: indel length: 0: CRISPR gRNA ID: GF-
CCELg12-291: [crRNA sequence]: crRNA sequence: TTTTATTTTTCTTTATGGGGCTTTCAGG
(SEQ ID NO: 893): LbgRNA: AATTCTAATACGACTCACTATAGgtaatttctactaagtgtagat
ATTTTTCTTTATGGGGCTTTCAGG (SEQ ID NO: 894): [Target gene information]: Gene ID:
4068: Symbol: SH2D1A: Ensembl_Transcript_ID: ENST00000371139.4: GRCh: 37: Chr: X:
[Target cancer mutation information]: mut_start: 123505240: mut_end: 123505240: mut_class:
Silent: mut_type: SNP: ref_seq: G: mut_seq: A: mut_aa: p.*129*: mutation info source: CCLE:
ref_target(-10 +10): AAAGCCCCATGAAGAAAAATA (SEQ ID NO: 887): mut_target(-10 +10):
AAAGCCCCATAAAGAAAAATA (SEQ ID NO: 888): [Model Cell line information]: cell:
NCIH661: cancer_type: LUNG: PAM_dist: 10: indel length: 0: CRISPR gRNA ID: GF-
CCELg12-292: [crRNA sequence]: crRNA sequence: TTTTTCTTTATGGGGCTTTCAGGCAGAC
(SEQ ID NO: 895): LbgRNA: AATTCTAATACGACTCACTATAGgtaatttctactaagtgtagat
TCTTTATGGGGCTTTCAGGCAGAC (SEQ ID NO: 896): [Target gene information]: Gene ID:
4068: Symbol: SH2D1A: Ensembl_Transcript_ID: ENST00000371139.4: GRCh: 37: Chr: X:
[Target cancer mutation information]: mut_start: 123505240: mut_end: 123505240: mut_class:
Silent: mut_type: SNP: ref_seq: G: mut_seq: A: mut_aa: p.*129*: mutation info source: CCLE:
ref_target(-10 +10): AAAGCCCCATGAAGAAAAATA (SEQ ID NO: 887): mut_target(-10 +10):
AAAGCCCCATAAAGAAAAATA (SEQ ID NO: 888): [Model Cell line information]: cell:
NCIH661: cancer_type: LUNG: PAM_dist: 5: indel length: 0: CRISPR gRNA ID: GF-CCELg12-
293: [crRNA sequence]: crRNA sequence: TTTTCTTTATGGGGCTTTCAGGCAGACA (SEQ ID
NO: 897): LbgRNA: AATTCTAATACGACTCACTATAGgtaatttctactaagtgtagat
CTTTATGGGGCTTTCAGGCAGACA (SEQ ID NO: 898): [Target gene information]: Gene ID:
4068: Symbol: SH2D1A: Ensembl_Transcript_ID: ENST00000371139.4: GRCh: 37: Chr: X:
[Target cancer mutation information]: mut_start: 123505240: mut_end: 123505240: mut_class:
Silent: mut_type: SNP: ref_seq: G: mut_seq: A: mut_aa: p.*129*: mutation info source: CCLE:
ref_target(-10 +10): AAAGCCCCATGAAGAAAAATA (SEQ ID NO: 887): mut_target(-10 +10):
AAAGCCCCATAAAGAAAAATA (SEQ ID NO: 888): [Model Cell line information]: cell:
NCIH661: cancer_type: LUNG: PAM_dist: 4: indel length: 0: CRISPR gRNA ID: GF-CCELg12-
294: [crRNA sequence]: crRNA sequence: TTTGGAGAGGCTGGTGTCCCTGTACAAC (SEQ ID
NO: 899): LbgRNA: AATTCTAATACGACTCACTATAGgtaatttctactaagtgtagat
GAGAGGCTGGTGTCCCTGTACAAC (SEQ ID NO: 900): [Target gene information]: Gene ID:
6597: Symbol: SMARCA4: Ensembl_Transcript_ID: ENST00000429416.3: GRCh: 37: Chr: 19:
[Target cancer mutation information]: mut_start: 11123640: mut_end: 11123640: mut_class:
Missense_Mutation: mut_type: SNP: ref_seq: T: mut_seq: A: mut_aa: p.W764R: mutation info
source: CCLE: ref_target(-10 +10): AGGTTTGGAGTGGCTGGTGTC (SEQ ID NO: 901):
mut_target(-10 +10): AGGTTTGGAGAGGCTGGTGTC (SEQ ID NO: 902): [Model Cell line
information]: cell: NCIH2126: cancer_type: LUNG: PAM_dist: 4: indel length: 0: CRISPR
gRNA ID: GF-CCELg12-295: [crRNA sequence]: crRNA sequence:
TTTCTGCCCAGTGCACCGGCCCCAGTGG (SEQ ID NO: 903): LbgRNA:
AATTCTAATACGACTCACTATAGgtaatttctactaagtgtagat TGCCCAGTGCACCGGCCCCAGTGG
(SEQ ID NO: 904): [Target gene information]: Gene ID: 6608: Symbol: SMO:
Ensembl_Transcript_ID: ENST00000249373.3: GRCh: 37: Chr: 7: [Target cancer mutation
information]: mut_start: 128852193: mut_end: 128852193: mut_class: Silent: mut_type: SNP:
ref_seq: C: mut_seq: A: mut_aa: p.P755P: mutation info source: CCLE: ref_target(-10 +10):
CACCGGCCCCCGTGGCATGGG (SEQ ID NO: 905): mut_target(-10 +10):
CACCGGCCCCAGTGGCATGGG (SEQ ID NO: 906): [Model Cell line information]: cell:
NCIH2126: cancer_type: LUNG: PAM_dist: 20: indel length: 0: CRISPR gRNA ID: GF-
CCELg12-296: [crRNA sequence]: crRNA sequence:
TTTGTCTCCATGGGAGTGGAAGGCGCCT (SEQ ID NO: 907): LbgRNA:
AATTCTAATACGACTCACTATAGgtaatttctactaagtgtagat TCTCCATGGGAGTGGAAGGCGCCT
(SEQ ID NO: 908): [Target gene information]: Gene ID: 51684: Symbol: SUFU:
Ensembl_Transcript_ID: ENST00000369902.3: GRCh: 37: Chr: 10: [Target cancer mutation
information]: mut_start: 104377121: mut_end: 104377121: mut_class: Missense_Mutation:
mut_type: SNP: ref_seq: C: mut_seq: T: mut_aa: p.T411M: mutation info source: CCLE:
ref_target(-10 +10): TTTGTCTCCACGGGAGTGGAA (SEQ ID NO: 909): mut_target(-10 +10):
TTTGTCTCCATGGGAGTGGAA (SEQ ID NO: 910): [Model Cell line information]: cell: A549:
cancer_type: LUNG: PAM_dist: 7: indel length: 0: CRISPR gRNA ID: GF-CCELg12-297:
[crRNA sequence]: crRNA sequence: TTTCTTGGCTTACCCCGAAGTTACATCT (SEQ ID NO:
911): LbgRNA: AATTCTAATACGACTCACTATAGgtaatttctactaagtgtagat
TTGGCTTACCCCGAAGTTACATCT (SEQ ID NO: 912): [Target gene information]: Gene ID:
54790: Symbol: TET2: Ensembl_Transcript_ID: ENST00000540549.1: GRCh: 37: Chr: 4:
[Target cancer mutation information]: mut_start: 106155466: mut_end: 106155466: mut_class:
Missense_Mutation: mut_type: SNP: ref_seq: C: mut_seq: T: mut_aa: p.R123C: mutation info
source: CCLE: ref_target(-10 +10): TGGAGAAAGACGTAACTTCGG (SEQ ID NO: 913):
mut_target(-10 +10): TGGAGAAAGATGTAACTTCGG (SEQ ID NO: 914): [Model Cell line TABLE 6-continued Illustrative guide RNA sequences for Cas12 comprising poylpeptide information]: cell: NCIH661: cancer_type: LUNG: PAM_dist: 21: indel length: 0: CRISPR
gRNA ID: GF-CCELg12-298: [crRNA sequence]: crRNA sequence:
TTTAGCATTGCAGCTCGTTTACTGGCAT (SEQ ID NO: 915): LbgRNA:
AATTCTAATACGACTCACTATAGgtaatttctactaagtgtagat GCATTGCAGCTCGTTTACTGGCAT
(SEQ ID NO: 916): [Target gene information]: Gene ID: 54790: Symbol: TET2:
Ensembl_Transcript_ID: ENST00000540549.1: GRCh: 37: Chr: 4: [Target cancer mutation
information]: mut_start: 106156019: mut_end: 106156019: mut_class: Missense_Mutation:
mut_type: SNP: ref_seq: T: mut_seq: G: mut_aa: p.L307R: mutation info source: CCLE:
ref_target(-10 +10): GCCAGTAAACTAGCTGCAATG (SEQ ID NO: 917): mut_target(-10 +10):
GCCAGTAAACGAGCTGCAATG (SEQ ID NO: 918): [Model Cell line information]: cell:
NCIH1573: cancer_type: LUNG: PAM_dist: 12: indel length: 0: CRISPR gRNA ID: GF-
CCELg12-299: [crRNA sequence]: crRNA sequence: TTTCTTAATCCACAATGCTGTAAGCCTA
(SEQ ID NO: 919): LbgRNA: AATTCTAATACGACTCACTATAGgtaatttctactaagtgtagat
TTAATCCACAATGCTGTAAGCCTA (SEQ ID NO: 920): [Target gene information]: Gene ID:
7046: Symbol: TGFBR1: Ensembl_Transcript_ID: ENST00000374994.4: GRCh: 37: Chr: 9:
[Target cancer mutation information]: mut_start: 101911534: mut_end: 101911534: mut_class:
Missense_Mutation: mut_type: SNP: ref_seq: C: mut_seq: T: mut_aa: p.R487W: mutation info
source: CCLE: ref_target(-10 +10): TACAGCATTGCGGATTAAGAA (SEQ ID NO: 921):
mut_target(-10 +10): TACAGCATTGTGGATTAAGAA (SEQ ID NO: 922): [Model Cell line
information]: cell: NCIH1437: cancer_type: LUNG: PAM_dist: 8: indel length: 0: CRISPR
gRNA ID: GF-CCELg12-300: [crRNA sequence]: crRNA sequence:
TTTTCTTAATCCACAATGCTGTAAGCCT (SEQ ID NO: 923): LbgRNA:
AATTCTAATACGACTCACTATAGgtaatttctactaagtgtagat CTTAATCCACAATGCTGTAAGCCT
(SEQ ID NO: 924): [Target gene information]: Gene ID: 7046: Symbol: TGFBR1:
Ensembl_Transcript_ID: ENST00000374994.4: GRCh: 37: Chr: 9: [Target cancer mutation
information]: mut_start: 101911534: mut_end: 101911534: mut_class: Missense_Mutation:
mut_type: SNP: ref_seq: C: mut_seq: T: mut_aa: p.R487W: mutation info source: CCLE:
ref_target(-10 +10): TACAGCATTGCGGATTAAGAA (SEQ ID NO: 921): mut_target(-10 +10):
TACAGCATTGTGGATTAAGAA (SEQ ID NO: 922): [Model Cell line information]: cell:
NCIH1437: cancer_type: LUNG: PAM_dist: 9: indel length: 0: CRISPR gRNA ID: GF-
CCELg12-301: [crRNA sequence]: crRNA sequence:
TTTGAAATCAAAGAGTATCTTGGTAAAG (SEQ ID NO: 925): LbgRNA:
AATTCTAATACGACTCACTATAGgtaatttctactaagtgtagat AAATCAAAGAGTATCTTGGTAAAG
(SEQ ID NO: 926): [Target gene information]: Gene ID: 7046: Symbol: TGFBR1:
Ensembl_Transcript_ID: ENST00000374994.4: GRCh: 37: Chr: 9: [Target cancer mutation
information]: mut_start: 101907053: mut_end: 101907053: mut_class: Missense_Mutation:
mut_type: SNP: ref_seq: A: mut_seq: G: mut_aa: p.N338S: mutation info source: CCLE:
ref_target(-10 +10): AAATCAAAGAATATCTTGGTA (SEQ ID NO: 927): mut_target(-10 +10):
AAATCAAAGAGTATCTTGGTA (SEQ ID NO: 928): [Model Cell line information]: cell: HPAFII:
cancer_type: PANCREAS: PAM_dist: 11: indel length: 0: CRISPR gRNA ID: GF-CCELg12-
302: [crRNA sequence]: crRNA sequence: TTTACCAAGATACTCTTTGATTTCAAAT (SEQ ID
NO: 929): LbgRNA: AATTCTAATACGACTCACTATAGgtaatttctactaagtgtagat
CCAAGATACTCTTTGATTTCAAAT (SEQ ID NO: 930): [Target gene information]: Gene ID:
7046: Symbol: TGFBR1: Ensembl_Transcript_ID: ENST00000374994.4: GRCh: 37: Chr: 9:
[Target cancer mutation information]: mut_start: 101907053: mut_end: 101907053: mut_class:
Missense_Mutation: mut_type: SNP: ref_seq: A: mut_seq: G: mut_aa: p.N338S: mutation info
source: CCLE: ref_target(-10 +10): AAATCAAAGAATATCTTGGTA (SEQ ID NO: 927):
mut_target(-10 +10): AAATCAAAGAGTATCTTGGTA (SEQ ID NO: 928): [Model Cell line
information]: cell: HPAFII: cancer_type: PANCREAS: PAM_dist: 9: indel length: 0: CRISPR
gRNA ID: GF-CCELg12-303: [crRNA sequence]: crRNA sequence:
TTTACAGACAATGGTACTTGGACTTAGC (SEQ ID NO: 931): LbgRNA:
AATTCTAATACGACTCACTATAGgtaatttctactaagtgtagat CAGACAATGGTACTTGGACTTAGC
(SEQ ID NO: 932): [Target gene information]: Gene ID: 7046: Symbol: TGFBR1:
Ensembl_Transcript_ID: ENST00000374994.4: GRCh: 37: Chr: 9: [Target cancer mutation
information]: mut_start: 101904835: mut_end: 101904835: mut_class: Nonsense_Mutation:
mut_type: SNP: ref_seq: C: mut_seq: T: mut_aa: p.Q275*: mutation info source: CCLE:
ref_target(-10 +10): TACTTGGACTCAGCTCTGGTT (SEQ ID NO: 933): mut_target(-10 +10):
TACTTGGACTTAGCTCTGGTT (SEQ ID NO: 934): [Model Cell line information]: cell:
NCIH1573: cancer_type: LUNG: PAM_dist: 21: indel length: 0: CRISPR gRNA ID: GF-
CCELg12-304: [crRNA sequence]: crRNA sequence:
TTTTACAGACAATGGTACTTGGACTTAG (SEQ ID NO: 935): LbgRNA:
AATTCTAATACGACTCACTATAGgtaatttctactaagtgtagat ACAGACAATGGTACTTGGACTTAG
(SEQ ID NO: 936): [Target gene information]: Gene ID: 7046: Symbol: TGFBR1:
Ensembl_Transcript_ID: ENST00000374994.4: GRCh: 37: Chr: 9: [Target cancer mutation
information]: mut_start: 101904835: mut_end: 101904835: mut_class: Nonsense_Mutation:
mut_type: SNP: ref_seq: C: mut_seq: T: mut_aa: p.Q275*: mutation info source: CCLE:
ref_target(-10 +10): TACTTGGACTCAGCTCTGGTT (SEQ ID NO: 933): mut_target(-10 +10):
TACTTGGACTTAGCTCTGGTT (SEQ ID NO: 934): [Model Cell line information]: cell:
NCIH1573: cancer_type: LUNG: PAM_dist: 22: indel length: 0: CRISPR gRNA ID: GF-
CCELg12-305: [crRNA sequence]: crRNA sequence: TTTCGACATATTGTGGTGGTGCCCTATG
(SEQ ID NO: 90): LbgRNA: AATTCTAATACGACTCACTATAGgtaatttctactaagtgtagat
GACATATTGTGGTGGTGCCCTATG (SEQ ID NO: 99): [Target gene information]: Gene ID:
7157: Symbol: TP53: Ensembl_Transcript_ID: ENST00000269305.4: GRCh: 37: Chr: 17:
[Target cancer mutation information]: mut_start: 7578205: mut_end: 7578205: mut_class:
Missense_Mutation: mut_type: SNP: ref_seq: C: mut_seq: A: mut_aa: p.S215I: mutation info
source: CCLE: ref_target(-10 +10): CACCACCACACTATGTCGAAA (SEQ ID NO: 93):
mut_target(-10 +10): CACCACCACAATATGTCGAAA (SEQ ID NO: 96): [Model Cell line
information]: cell: NCIH661: cancer_type: LUNG: PAM_dist: 7: indel length: 0: CRISPR gRNA TABLE 6-continued Illustrative guide RNA sequences for Cas12 comprising poylpeptide ID: GF-CCELg12-306: [crRNA sequence]: crRNA sequence:
TTTTCGACATATTGTGGTGGTGCCCTAT (SEQ ID NO: 937)): LbgRNA:
AATTCTAATACGACTCACTATAGgtaatttctactaagtgtagat CGACATATTGTGGTGGTGCCCTAT
(SEQ ID NO: 938): [Target gene information]: Gene ID: 7157: Symbol: TP53:
Ensembl_Transcript_ID: ENST00000269305.4: GRCh: 37: Chr: 17: [Target cancer mutation
information]: mut_start: 7578205: mut_end: 7578205: mut_class: Missense_Mutation: mut_type:
SNP: ref_seq: C: mut_seq: A: mut_aa: p.S215I: mutation info source: CCLE: ref_target(-10
+10): CACCACCACACTATGTCGAAA (SEQ ID NO: 93): mut_target(-10 +10):
CACCACCACAATATGTCGAAA (SEQ ID NO: 96): [Model Cell line information]: cell:
NCIH661: cancer_type: LUNG: PAM_dist: 8: indel length: 0: CRISPR gRNA ID: GF-CCELg12-
307: [crRNA sequence]: crRNA sequence: TTTGAGGTGCATGTTTGTGCCTGTCCTG (SEQ ID
NO: 939): LbgRNA: AATTCTAATACGACTCACTATAGgtaatttctactaagtgtagat
AGGTGCATGTTTGTGCCTGTCCTG (SEQ ID NO: 940): [Target gene information]: Gene ID:
7157: Symbol: TP53: Ensembl_Transcript_ID: ENST00000269305.4: GRCh: 37: Chr: 17:
[Target cancer mutation information]: mut_start: 7577120: mut_end: 7577120: mut_class:
Missense_Mutation: mut_type: SNP: ref_seq: C: mut_seq: T: mut_aa: p.R273H: mutation info
source: CCLE: ref_target(-10 +10): GGCACAAACACGCACCTCAAA (SEQ ID NO: 941):
mut_target(-10 +10): GGCACAAACATGCACCTCAAA (SEQ ID NO: 942): [Model Cell line
information]: cell: NCIH1975: cancer_type: LUNG: PAM_dist: 7: indel length: 0: CRISPR
gRNA ID: GF-CCELg12-308: [crRNA sequence]: crRNA sequence:
TTTCGACATAGTGTGGTGCCCTATGAGC (SEQ ID NO: 943): LbgRNA:
AATTCTAATACGACTCACTATAGgtaatttctactaagtgtagat GACATAGTGTGGTGCCCTATGAGC
(SEQ ID NO: 944): [Target gene information]: Gene ID: 7157: Symbol: TP53:
Ensembl_Transcript_ID: ENST00000269305.4: GRCh: 37: Chr: 17: [Target cancer mutation
information]: mut_start: 7578195: mut_end: 7578197: mut_class: In_Frame_Del: mut_type: DEL:
ref_seq: CAC: mut_seq: -: mut_aa: p.V218del: mutation info source: CCLE: ref_target(-10
+10): GCTCATAGGGCACCACCACACTA (SEQ ID NO: 945): mut_target(-10 +10):
GCTCATAGGG---CACCACACTA (SEQ ID NO: 946): [Model Cell line information]: cell:
HCC827GR5: cancer_type: LUNG: PAM_dist: 15: indel length: 3: CRISPR gRNA ID: GF-
CCELg12-309: [crRNA sequence]: crRNA sequence:
TTTTCGACATAGTGTGGTGCCCTATGAG (SEQ ID NO: 947): LbgRNA:
AATTCTAATACGACTCACTATAGgtaatttctactaagtgtagat CGACATAGTGTGGTGCCCTATGAG
(SEQ ID NO: 948): [Target gene information]: Gene ID: 7157: Symbol: TP53:
Ensembl_Transcript_ID: ENST00000269305.4: GRCh: 37: Chr: 17: [Target cancer mutation
information]: mut_start: 7578195: mut_end: 7578197: mut_class: In_Frame_Del: mut_type: DEL:
ref_seq: CAC: mut_seq: -: mut_aa: p.V218del: mutation info source: CCLE: ref_target(-10
+10): GCTCATAGGGCACCACCACACTA (SEQ ID NO: 945): mut_target(-10 +10):
GCTCATAGGG---CACCACACTA (SEQ ID NO: 946): [Model Cell line information]: cell:
HCC827GR5: cancer_type: LUNG: PAM_dist: 16: indel length: 3: CRISPR gRNA ID: GF-
CCELg12-310: [crRNA sequence]: crRNA sequence:
TTTCGACATAGTGTGGTGCCCTATGAGC (SEQ ID NO: 943): LbgRNA:
AATTCTAATACGACTCACTATAGgtaatttctactaagtgtagat GACATAGTGTGGTGCCCTATGAGC
(SEQ ID NO: 944): [Target gene information]: Gene ID: 7157: Symbol: TP53:
Ensembl_Transcript_ID: ENST00000269305.4: GRCh: 37: Chr: 17: [Target cancer mutation
information]: mut_start: 7578195: mut_end: 7578197: mut_class: In_Frame_Del: mut_type: DEL:
ref_seq: CAC: mut_seq: -: mut_aa: p.V218del: mutation info source: CCLE: ref_target(-10
+10): GCTCATAGGGCACCACCACACTA (SEQ ID NO: 945): mut_target(-10 +10):
GCTCATAGGG---CACCACACTA (SEQ ID NO: 946): [Model Cell line information]: cell:
HCC827: cancer_type: LUNG: PAM_dist: 15: indel length: 3: CRISPR gRNA ID: GF-CCELg12-
311: [crRNA sequence]: crRNA sequence: TTTTCGACATAGTGTGGTGCCCTATGAG (SEQ ID
NO: 947): LbgRNA: AATTCTAATACGACTCACTATAGgtaatttctactaagtgtagat
CGACATAGTGTGGTGCCCTATGAG (SEQ ID NO: 948): [Target gene information]: Gene ID:
7157: Symbol: TP53: Ensembl_Transcript_ID: ENST00000269305.4: GRCh: 37: Chr: 17:
[Target cancer mutation information]: mut_start: 7578195: mut_end: 7578197: mut_class:
In_Frame_Del: mut_type: DEL: ref_seq: CAC: mut_seq: -: mut_aa: p.V218del: mutation info
source: CCLE: ref_target(-10 +10): GCTCATAGGGCACCACCACACTA (SEQ ID NO: 945):
mut_target(-10 +10): GCTCATAGGG---CACCACACTA (SEQ ID NO: 946): [Model Cell line
information]: cell: HCC827: cancer_type: LUNG: PAM_dist: 16: indel length: 3: CRISPR gRNA
ID: GF-CCELg12-312: [crRNA sequence]: crRNA sequence:
TTTCCTTCCACTCGGATAAGATGCTTGAG (SEQ ID NO: 949): LbgRNA:
AATTCTAATACGACTCACTATAGgtaatttctactaagtgtagat CTTCCACTCGGATAAGATGCTGAG
(SEQ ID NO: 950): [Target gene information]: Gene ID: 7157: Symbol: TP53:
Ensembl_Transcript_ID: ENST00000269305.4: GRCh: 37: Chr: 17: [Target cancer mutation
information]: mut_start: 7578275: mut_end: 7578277: mut_class: In_Frame_Del: mut_type: DEL:
ref_seq: GAG: mut_seq: -: mut_aa: p.P191del: mutation info source: CCLE: ref_target(-10 +10):
ATAAGATGCTGAGGAGGGGCCAG (SEQ ID NO: 951): mut_target(-10 +10): ATAAGATGCT---GAGGGGCCAG (SEQ ID NO: 952): [Model Cell line information]: cell: SW1990: cancer_type:
PANCREAS: PAM_dist: 22: indel length: 3: CRISPR gRNA ID: GF-CCELg12-313: [crRNA
sequence]: crRNA sequence: TTTGCTGGCTGGAAAGGGGTGACTCGCT (SEQ ID NO: 953):
LbgRNA: AATTCTAATACGACTCACTATAGgtaatttctactaagtgtagat
CTGGCTGGAAAGGGGTGACTCGCT (SEQ ID NO: 954): [Target gene information]: Gene ID:
7186: Symbol: TRAF2: Ensembl_Transcript_ID: ENST00000536468.1: GRCh: 37: Chr: 9:
[Target cancer mutation information]: mut_start: 139777164: mut_end: 139777164: mut_class:
Splice_Site: mut_type: SNP: ref_seq: T: mut_seq: C: mut_aa: FALSE: mutation info source:
CCLE: ref_target(-10 +10): ATGGCCAGAGTGAGTCACCCC (SEQ ID NO: 955): mut_target(-10
+10): ATGGCCAGAGCGAGTCACCCC (SEQ ID NO: 956): [Model Cell line information]: cell:
NCIH1975: cancer_type: LUNG: PAM_dist: 22: indel length: 0: CRISPR gRNA ID: GF-
CCELg12-314: [crRNA sequence]: crRNA sequence:

TABLE 6-continued

Illustrative guide RNA sequences for Cas12 comprising poylpeptide

TTTATGGTTTCGGAGGCCCGACCGGGGC (SEQ ID NO: 957): LbgRNA:
AATTCTAATACGACTCACTATAGgtaatttctactaagtgtagat TGGTTTCGGAGGCCCGACCGGGGC
(SEQ ID NO: 958): [Target gene information]: Gene ID: 7422: Symbol: VEGFA:
Ensembl_Transcript_ID: ENST00000523873.1: GRCh: 37: Chr: 6: [Target cancer mutation
information]: mut_start: 43738986: mut_end: 43738986: mut_class: Start_Codon_SNP: mut_type:
SNP: ref_seq: G: mut_seq: A: mut_aa: p.M1I: mutation info source: CCLE: ref_target(-10 +10):
CCGAAACCATGAACTTTCTGC (SEQ ID NO: 959): mut_target(-10 +10):
CCGAAACCATAAACTTTCTGC (SEQ ID NO: 960): [Model Cell line information]: cell: HCC827:
cancer_type: LUNG: PAM_dist: -1: indel length: 0: CRISPR gRNA ID: GF-CCELg12-315:
[crRNA sequence]: crRNA sequence: TTTCAAGAAAAAATTTTTATGTCTTAAT (SEQ ID NO:
961): LbgRNA: AATTCTAATACGACTCACTATAGgtaatttctactaagtgtagat
AAGAAAAAATTTTTATGTCTTAAT (SEQ ID NO: 962): [Target gene information]: Gene ID:
331: Symbol: XIAP: Ensembl_Transcript_ID: ENST00000371199.3: GRCh: 37: Chr: X: [Target
cancer mutation information]: mut_start: 123041011: mut_end: 123041012: mut_class:
Frame_Shift_Ins: mut_type: INS: ref_seq: -: mut_seq: A: mut_aa: p.Q492fs: mutation info
source: CCLE: ref_target(-10 +10): TACTTTCAAG-AAAAATTTTT (SEQ ID NO: 963):
mut_target(-10 +10): TACTTTCAAGAAAAAATTTTT (SEQ ID NO: 964): [Model Cell line
information]: cell: A549: cancer_type: LUNG: PAM_dist: 4: indel length: 1: CRISPR gRNA ID:
GF-CCELg12-316: [crRNA sequence]: crRNA sequence:
TTTTCTTGAAAGTAATGACTGTGTAGCAC (SEQ ID NO: 965): LbgRNA:
AATTCTAATACGACTCACTATAGgtaatttctactaagtgtagat TTGAAAGTAATGACTGTGTAGCAC
(SEQ ID NO: 966): [Target gene information]: Gene ID: 331: Symbol: XIAP:
Ensembl_Transcript_ID: ENST00000371199.3: GRCh: 37: Chr: X: [Target cancer mutation
information]: mut_start: 123041011: mut_end: 123041012: mut_class: Frame_Shift_Ins:
mut_type: INS: ref_seq: -: mut_seq: A: mut_aa: p.Q492fs: mutation info source: CCLE:
ref_target(-10 +10): TACTTTCAAG-AAAAATTTTT (SEQ ID NO: 963): mut_target(-10 +10):
TACTTTCAAGAAAAAATTTTT (SEQ ID NO: 964): [Model Cell line information]: cell: A549:
cancer_type: LUNG: PAM_dist: -1: indel length: 1: CRISPR gRNA ID: GF-CCELg12-317:
[crRNA sequence]: crRNA sequence: TTTTTTCTTGAAAGTAATGACTGTGTAG (SEQ ID NO:
967): LbgRNA: AATTCTAATACGACTCACTATAGgtaatttctactaagtgtagat
TTCTTGAAAGTAATGACTGTGTAG (SEQ ID NO: 968): [Target gene information]: Gene ID:
331: Symbol: XIAP: Ensembl_Transcript_ID: ENST00000371199.3: GRCh: 37: Chr: X: [Target
cancer mutation information]: mut_start: 123041011: mut_end: 123041012: mut_class:
Frame_Shift_Ins: mut_type: INS: ref_seq: -: mut_seq: A: mut_aa: p.Q492fs: mutation info
source: CCLE: ref_target(-10 +10): TACTTTCAAG-AAAAATTTTT (SEQ ID NO: 963):
mut_target(-10 +10): TACTTTCAAGAAAAAATTTTT (SEQ ID NO: 964): [Model Cell line
information]: cell: A549: cancer_type: LUNG: PAM_dist: 2: indel length: 1: CRISPR gRNA ID:
GF-CCELg12-318: [crRNA sequence]: crRNA sequence:
TTTTTCTTGAAAGTAATGACTGTGTAGC (SEQ ID NO: 969): LbgRNA:
AATTCTAATACGACTCACTATAGgtaatttctactaagtgtagat TCTTGAAAGTAATGACTGTGTAGC
(SEQ ID NO: 970): [Target gene information]: Gene ID: 331: Symbol: XIAP:
Ensembl_Transcript_ID: ENST00000371199.3: GRCh: 37: Chr: X: [Target cancer mutation
information]: mut_start: 123041011: mut_end: 123041012: mut_class: Frame_Shift_Ins:
mut_type: INS: ref_seq: -: mut_seq: A: mut_aa: p.Q492fs: mutation info source: CCLE:
ref_target(-10 +10): TACTTTCAAG-AAAAATTTTT (SEQ ID NO: 963): mut_target(-10 +10):
TACTTTCAAGAAAAAATTTTT (SEQ ID NO: 964): [Model Cell line information]: cell: A549:
cancer_type: LUNG: PAM_dist: 1: indel length: 1: CRISPR gRNA ID: GF-CCELg12-319:
[crRNA sequence]: crRNA sequence: TTTTTCTTGAAAGTAATGACTGTGTAGCA (SEQ ID NO:
971): LbgRNA: AATTCTAATACGACTCACTATAGgtaatttctactaagtgtagat
CTTGAAAGTAATGACTGTGTAGCA (SEQ ID NO: 972): [Target gene information]: Gene ID:
331: Symbol: XIAP: Ensembl_Transcript_ID: ENST00000371199.3: GRCh: 37: Chr: X: [Target
cancer mutation information]: mut_start: 123041011: mut_end: 123041012: mut_class:
Frame_Shift_Ins: mut_type: INS: ref_seq: -: mut_seq: A: mut_aa: p.Q492fs: mutation info
source: CCLE: ref_target(-10 +10): TACTTTCAAG-AAAAATTTTT (SEQ ID NO: 963):
mut_target(-10 +10): TACTTTCAAGAAAAAATTTTT (SEQ ID NO: 964): [Model Cell line
information]: cell: A549: cancer_type: LUNG: PAM_dist: 0: indel length: 1: : CRISPR gRNA
ID: GF-CCELg12-320: [crRNA sequence]: crRNA sequence:
TTTCAACTATGTCAGTTTGTAATGGTAA (SEQ ID NO: 973): LbgRNA:
AATTCTAATACGACTCACTATAGgtaatttctactaagtgtagat AACTATGTCAGTTTGTAATGGTAA
(SEQ ID NO: 974): [Target gene information]: Gene ID: 7514: Symbol: XPO1:
Ensembl_Transcript_ID: ENST00000401558.2: GRCh: 37: Chr: 2: [Target cancer mutation
information]: mut_start: 61726015: mut_end: 61726015: mut_class: Silent: mut_type: SNP:
ref_seq: C: mut_seq: T: mut_aa: p.L208L: mutation info source: CCLE: ref_target(-10 +10):
CAAACTGACACAGTTGAAATA (SEQ ID NO: 975): mut_target(-10 +10):
CAAACTGACATAGTTGAAATA (SEQ ID NO: 976): [Model Cell line information]: cell:
NCIH1573: cancer_type: LUNG: PAM_dist: 5: indel length: 0: CRISPR gRNA ID: GF-
CCELg12-321: [crRNA sequence]: crRNA sequence:
TTTGAGATATGCTGTTGGGAAACGATA (SEQ ID NO: 977): LbgRNA:
AATTCTAATACGACTCACTATAGgtaatttctactaagtgtagat GAGATATGCTGTTGGGAAACGATA
(SEQ ID NO: 978): [Target gene information]: Gene ID: 463: Symbol: ZFHX3:
Ensembl_Transcript_ID: ENST00000268489.5: GRCh: 37: Chr: 16: [Target cancer mutation
information]: mut_start: 72827451: mut_end: 72827451: mut_class: Missense_Mutation:
mut_type: SNP: ref_seq: A: mut_seq: C: mut_aa: p.F3044V: mutation info source: CCLE:
ref_target(-10 +10): TGTTGGGAAAAGATATGGTCA (SEQ ID NO: 979): mut_target(-10 +10):
TGTTGGGAAACGATATGGTCA (SEQ ID NO: 980): [Model Cell line information]: cell:
NCIH1299: cancer_type: LUNG: PAM_dist: 20: indel length: 0: CRISPR gRNA ID: GF-
CCELg12-322: [crRNA sequence]: crRNA sequence: TTTGGGACCCTCCACCGGGCTCGCCTGT
(SEQ ID NO: 981): LbgRNA: AATTCTAATACGACTCACTATAGgtaatttctactaagtgtagat TABLE 6-continued Illustrative guide RNA sequences for Cas12 comprising poylpeptide GGACCCTCCACCGGGCTCGCCTGT (SEQ ID NO: 982): [Target gene information]: Gene ID:
463: Symbol: ZFHX3: Ensembl_Transcript_ID: ENST00000268489.5: GRCh: 37: Chr: 16:
[Target cancer mutation information]: mut_start: 72821151: mut_end: 72821151: mut_class:
Missense_Mutation: mut_type: SNP: ref_seq: G: mut_seq: T: mut_aa: p.P3675Q: mutation info
source: CCLE: ref_target(-10 +10): CGGGCTCGCCGGTCCGTCGGA (SEQ ID NO: 983):
mut_target(-10 +10): CGGGCTCGCCTGTCCGTCGGA (SEQ ID NO: 984): [Model Cell line
information]: cell: NCIH460: cancer_type: LUNG: PAM_dist: 22: indel length: 0: :

Table 7 and paragraph [00305] lists illustrative guide RNA sequences, determined using the methods described in Example 10, which can be used to guide a polypeptide comprising a Cas9 nuclease domain (e.g., a chimeric polypeptide comprising a Cas9 nuclease) to a target nucleic acid associated with a cancer, for example, lung cancer or pancreatic cancer. Variations from a reference sequence (e.g., wild type, healthy, or non-cancerous) are shown in underlined text.

TABLE 7

Illustrative guide RNA sequences for polypeptides comprising Cas9

CRISPR gRNA ID: GF-CCELg9-1: [crRNA sequence]: crRNA sequence:
TGCTCCTGCCTTTTCCTCACTGG (SEQ ID NO: 985):
SpgRNA: attctaatacgactcactataggTGCTCCTGCCTTTTCCTCACgttttagagctagaaatagcaagttaaaataaggctagtccgttat
caacttgaaaaagtggcaccgagtcggtgc (SEQ ID NO: 986): [Target gene information]: Gene ID: 29123: Symbol:
ANKRD11: Ensembl Transcript ID: ENST00000301030.4: GRCh: 37: Chr: 16: [Target cancer mutation
information]: mut start: 89351168: mut end: 89351168: mut class: Silent: mut type: SNP: ref seq: C: mut
seq: T: mut aa: p.K594K: mutation info source: CCLE: ref target(-10 +10): GCTCCTGCCTCTTCCTCACTG
(SEQ ID NO: 114): mut target(-10 +10): GCTCCTGCCTTTTCCTCACTG (SEQ ID NO: 115): [Model
Cell line information]: cell: NCIH1573: cancer type: LUNG: PAM dist: 9: indel length: 0: CRISPR gRNA
ID: GF-CCELg9-2: [crRNA sequence]: crRNA sequence: CGCTGAAGCCAGTGAGGAAAAGG (SEQ ID
NO: 987):
SpgRNA: attctaatacgactcactataggCGCTGAAGCCAGTGAGGAAAgttttagagctagaaatagcaagttaaaataaggctagtccgt
tatcaacttgaaaaagtggcaccgagtcggtgc (SEQ ID NO: 988): [Target gene information]: Gene ID: 29123: Symbol:
ANKRD11: Ensembl Transcript ID: ENST00000301030.4: GRCh: 37: Chr: 16: [Target cancer mutation
information]: mut start: 89351168: mut end: 89351168: mut class: Silent: mut type: SNP: ref seq: C: mut
seq: T: mut aa: p.K594K: mutation info source: CCLE: ref target(-10 +10): GCTCCTGCCTCTTCCTCACTG
(SEQ ID NO: 114): mut target(-10 +10): GCTCCTGCCTTTTCCTCACTG (SEQ ID NO: 115): [Model
Cell line information]: cell: NCIH1573: cancer type: LUNG: PAM dist: 1: indel length: 0: CRISPR gRNA
ID: GF-CCELg9-3: [crRNA sequence]: crRNA sequence: GAAGCCAGTGAGGAAAAGGCAGG (SEQ ID
NO: 989):
SpgRNA: attctaatacgactcactataggGAAGCCAGTGAGGAAAAGGCgttttagagctagaaatagcaagttaaaataaggctagtccg
ttatcaacttgaaaaagtggcaccgagtcggtgc (SEQ ID NO: 990): [Target gene information]: Gene ID: 29123:
Symbol: ANKRD11: Ensembl Transcript ID: ENST00000301030.4: GRCh: 37: Chr: 16: [Target cancer
mutation information]: mut start: 89351168: mut end: 89351168: mut class: Silent: mut type: SNP: ref seq:
C: mut seq: T: mut aa: p.K594K: mutation info source: CCLE: ref target(-10 +10):
GCTCCTGCCTCTTCCTCACTG (SEQ ID NO: 114): mut target(-10 +10):
GCTCCTGCCTTTTCCTCACTG (SEQ ID NO: 115): [Model Cell line information]: cell: NCIH1573:
cancer type: LUNG: PAM dist: 5: indel length: 0: CRISPR gRNA ID: GF-CCELg9-4: [crRNA sequence]:
crRNA sequence: TGAGGAAAAGGCAGGAGCACAGG (SEQ ID NO: 991):
SpgRNA: attctaatacgactcactataggTGAGGAAAAGGCAGGAGCACgttttagagctagaaatagcaagttaaaataaggctagtccg
ttatcaacttgaaaaagtggcaccgagtcggtgc (SEQ ID NO: 992): [Target gene information]: Gene ID: 29123:
Symbol: ANKRD11: Ensembl Transcript ID: ENST00000301030.4: GRCh: 37: Chr: 16: [Target cancer
mutation information]: mut start: 89351168: mut end: 89351168: mut class: Silent: mut type: SNP: ref seq:
C: mut seq: T: mut aa: p.K594K: mutation info source: CCLE: ref target(-10 +10):
GCTCCTGCCTCTTCCTCACTG (SEQ ID NO: 114): mut target(-10 +10):
GCTCCTGCCTTTTCCTCACTG (SEQ ID NO: 115): [Model Cell line information]: cell: NCIH1573:
cancer type: LUNG: PAM dist: 13: indel length: 0: CRISPR gRNA ID: GF-CCELg9-5: [crRNA sequence]:
crRNA sequence: GACCCTCCTCCAGCGGCTCCAGG (SEQ ID NO: 993):
SpgRNA: attctaatacgactcactataggGACCCTCCTCCAGCGGCTCCgttttagagctagaaatagcaagttaaaataaggctagtccgtt
atcaacttgaaaaagtggcaccgagtcggtgc (SEQ ID NO: 994): [Target gene information]: Gene ID: 29123: Symbol:
ANKRD11: Ensembl Transcript ID: ENST00000301030.4: GRCh: 37: Chr: 16: [Target cancer mutation
information]: mut start: 89347145: mut end: 89347145: mut class: Missense Mutation: mut type: SNP: ref
seq: G: mut seq: C: mut aa: p.D1935E: mutation info source: CCLE: ref target(-10 +10):
AGGGACCCTCCGTCCAGCGGCT (SEQ ID NO: 995): mut target(-10 +10):
AGGGACCCTCCTCCAGCGGCT (SEQ ID NO: 996): [Model Cell line information]: cell: NCIH1299:
cancer type: LUNG: PAM dist: 13: indel length: 0: CRISPR gRNA ID: GF-CCELg9-6: [crRNA sequence]:
crRNA sequence: CTCCAGCGGCTCCAGGTAGCTGG (SEQ ID NO: 997):
SpgRNA: attctaatacgactcactataggCTCCAGCGGCTCCAGGTAGCgttttagagctagaaatagcaagttaaaataaggctagtccgtt
atcaacttgaaaaagtggcaccgagtcggtgc (SEQ ID NO: 998): [Target gene information]: Gene ID: 29123: Symbol:
ANKRD11: Ensembl Transcript ID: ENST00000301030.4: GRCh: 37: Chr: 16: [Target cancer mutation
information]: mut start: 89347145: mut end: 89347145: mut class: Missense Mutation: mut type: SNP: ref
seq: G: mut seq: C: mut aa: p.D1935E: mutation info source: CCLE: ref target(-10 +10):

TABLE 7-continued

Illustrative guide RNA sequences for polypeptides comprising Cas9

AGGGACCCTCGTCCAGCGGCT (SEQ ID NO: 995): mut target(-10 +10):
AGGGACCCTCCTCCAGCGGCT (SEQ ID NO: 996): [Model Cell line information]: cell: NCIH1299:
cancer type: LUNG: PAM dist: 20: indel length: 0: CRISPR gRNA ID: GF-CCELg9-7: [crRNA sequence]:
crRNA sequence: CTGAAGGGACCCTCCTCCAGCGG (SEQ ID NO: 999):
SpgRNA: attctaatacgactcactataggCTGAAGGGACCCTCCTCCAGgttttagagctagaaatagcaagttaaaataaggctagtccgtt
atcaacttgaaaaagtggcaccgagtcggtgc (SEQ ID NO: 1000): [Target gene information]: Gene ID: 29123:
Symbol: ANKRD11: Ensembl Transcript ID: ENST00000301030.4: GRCh: 37: Chr: 16: [Target cancer
mutation information]: mut start: 89347145: mut end: 89347145: mut class: Missense Mutation: mut type:
SNP: ref seq: G: mut seq: C: mut aa: p.D1935E: mutation info source: CCLE: ref target(-10 +10):
AGGGACCCTCGTCCAGCGGCT (SEQ ID NO: 995): mut target(-10 +10):
AGGGACCCTCCTCCAGCGGCT (SEQ ID NO: 996): [Model Cell line information]: cell: NCIH1299:
cancer type: LUNG: PAM dist: 6: indel length: 0: CRISPR gRNA ID: GF-CCELg9-8: [crRNA sequence]:
crRNA sequence: CAGCTACCTGGAGCCGCTGGAGG (SEQ ID NO: 1001):
SpgRNA: attctaatacgactcactataggCAGCTACCTGGAGCCGCTGGgttttagagctagaaatagcaagttaaaataaggctagtccgtt
atcaacttgaaaaagtggcaccgagtcggtgc (SEQ ID NO: 1002): [Target gene information]: Gene ID: 29123:
Symbol: ANKRD11: Ensembl Transcript ID: ENST00000301030.4: GRCh: 37: Chr: 16: [Target cancer
mutation information]: mut start: 89347145: mut end: 89347145: mut class: Missense Mutation: mut type:
SNP: ref seq: G: mut seq: C: mut aa: p.D1935E: mutation info source: CCLE: ref target(-10 +10):
AGGGACCCTCGTCCAGCGGCT (SEQ ID NO: 995): mut target(-10 +10):
AGGGACCCTCCTCCAGCGGCT (SEQ ID NO: 996): [Model Cell line information]: cell: NCIH1299:
cancer type: LUNG: PAM dist: -1: indel length: 0: CRISPR gRNA ID: GF-CCELg9-9: [crRNA sequence]:
crRNA sequence: CTACCTGGAGCCGCTGGAGGAGG (SEQ ID NO: 1003):
SpgRNA: attctaatacgactcactataggCTACCTGGAGCCGCTGGAGGAGgttttagagctagaaatagcaagttaaaataaggctagtccgtt
atcaacttgaaaaagtggcaccgagtcggtgc (SEQ ID NO: 1004): [Target gene information]: Gene ID: 29123:
Symbol: ANKRD11: Ensembl Transcript ID: ENST00000301030.4: GRCh: 37: Chr: 16: [Target cancer
mutation information]: mut start: 89347145: mut end: 89347145: mut class: Missense Mutation: mut type:
SNP: ref seq: G: mut seq: C: mut aa: p.D1935E: mutation info source: CCLE: ref target(-10 +10):
AGGGACCCTCGTCCAGCGGCT (SEQ ID NO: 995): mut target(-10 +10):
AGGGACCCTCCTCCAGCGGCT (SEQ ID NO: 996): [Model Cell line information]: cell: NCIH1299:
cancer type: LUNG: PAM dist: 2: indel length: 0: CRISPR gRNA ID: GF-CCELg9-10: [crRNA sequence]:
crRNA sequence: TACCTGGAGCCGCTGGAGGAGGG (SEQ ID NO: 1005):
SpgRNA: attctaatacgactcactataggTACCTGGAGCCGCTGGAGGAGgttttagagctagaaatagcaagttaaaataaggctagtccgt
tatcaacttgaaaaagtggcaccgagtcggtgc (SEQ ID NO: 1006): [Target gene information]: Gene ID: 29123:
Symbol: ANKRD11: Ensembl Transcript ID: ENST00000301030.4: GRCh: 37: Chr: 16: [Target cancer
mutation information]: mut start: 89347145: mut end: 89347145: mut class: Missense Mutation: mut type:
SNP: ref seq: G: mut seq: C: mut aa: p.D1935E: mutation info source: CCLE: ref target(-10 +10):
AGGGACCCTCGTCCAGCGGCT (SEQ ID NO: 995): mut target(-10 +10):
AGGGACCCTCCTCCAGCGGCT (SEQ ID NO: 996): [Model Cell line information]: cell: NCIH1299:
cancer type: LUNG: PAM dist: 3: indel length: 0: CRISPR gRNA ID: GF-CCELg9-11: [crRNA sequence]:
crRNA sequence: ACGAAATCTCCCTCCAAAAGTGG (SEQ ID NO: 1007):
SpgRNA: attctaatacgactcactataggACGAAATCTCCCTCCAAAAGgttttagagctagaaatagcaagttaaaataaggctagtccgtt
atcaacttgaaaaagtggcaccgagtcggtgc (SEQ ID NO: 1008): [Target gene information]: Gene ID: 324: Symbol:
APC: Ensembl Transcript ID: ENST00000457016.1: GRCh: 37: Chr: 5: [Target cancer mutation information]:
mut start: 112175363: mut end: 112175363: mut class: Missense Mutation: mut type: SNP: ref seq: G: mut
seq: A: mut aa: p.A1358T: mutation info source: CCLE: ref target(-10 +10):
TTCTTCAGGACGAAATCTCC (SEQ ID NO: 120): mut target(-10 +10):
TTCTTCAGGAACGAAATCTCC (SEQ ID NO: 121): [Model Cell line information]: cell: NCIH1650:
cancer type: LUNG: PAM dist: 20: indel length: 0: CRISPR gRNA ID: GF-CCELg9-12: [crRNA sequence]:
crRNA sequence: TGCATCCTTTCCCTGAAATCAGG (SEQ ID NO: 1009):
SpgRNA: attctaatacgactcactataggTGCATCCTTTCCCTGAAATCgttttagagctagaaatagcaagttaaaataaggctagtccgtta
tcaacttgaaaaagtggcaccgagtcggtgc (SEQ ID NO: 1010): [Target gene information]: Gene ID: 324: Symbol:
APC: Ensembl Transcript ID: ENST00000457016.1: GRCh: 37: Chr: 5: [Target cancer mutation information]:
mut start: 112177692: mut end: 112177692: mut class: Missense Mutation: mut type: SNP: ref seq: C: mut
seq: G: mut aa: p.S2134C: mutation info source: CCLE: ref target(-10 +10):
GATTCAGATTCCATCCTTTCC (SEQ ID NO: 132): mut target(-10 +10):
GATTCAGATTGCATCCTTTCC (SEQ ID NO: 133): [Model Cell line information]: cell: NCIH1975:
cancer type: LUNG: PAM dist: 19: indel length: 0: CRISPR gRNA ID: GF-CCELg9-13: [crRNA sequence]:
crRNA sequence: TTGTTGCTGGCTGGCAGGCTAGG (SEQ ID NO: 1011):
SpgRNA: attctaatacgactcactataggTTGTTGCTGGCTGGCAGGCTgttttagagctagaaatagcaagttaaaataaggctagtccgtt
atcaacttgaaaaagtggcaccgagtcggtgc (SEQ ID NO: 1012): [Target gene information]: Gene ID: 8289: Symbol:
ARID1A: Ensembl Transcript ID: EN5T00000324856.7: GRCh: 37: Chr: 1: [Target cancer mutation
information]: mut start: 27100949: mut end: 27100949: mut class: Nonsense Mutation: mut type: SNP: ref
seq: C: mut seq: T: mut aa: p.Q1411*: mutation info source: CCLE: ref target(-10 +10):
AGCCCAGCCCCAGCCTGCCAG (SEQ ID NO: 1013): mut target(-10 +10):
AGCCCAGCCCTAGCCTGCCAG (SEQ ID NO: 1014): [Model Cell line information]: cell: NCIH1563:
cancer type: LUNG: PAM dist: 0: indel length: 0: CRISPR gRNA ID: GF-CCELg9-14: [crRNA sequence]:
crRNA sequence: GCTGGCTGGCAGGCTAGGGCTGG (SEQ ID NO: 1015):
SpgRNA: attctaatacgactcactataggGCTGGCTGGCAGGCTAGGGCgttttagagctagaaatagcaagttaaaataaggctagtccgt
tatcaacttgaaaaagtggcaccgagtcggtgc (SEQ ID NO: 1016): [Target gene information]: Gene ID: 8289: Symbol:
ARID1A: Ensembl Transcript ID: EN5T00000324856.7: GRCh: 37: Chr: 1: [Target cancer mutation
information]: mut start: 27100949: mut end: 27100949: mut class: Nonsense Mutation: mut type: SNP: ref
seq: C: mut seq: T: mut aa: p.Q1411*: mutation info source: CCLE: ref target(-10 +10):
AGCCCAGCCCCAGCCTGCCAG (SEQ ID NO: 1013): mut target(-10 +10):
AGCCCAGCCCTAGCCTGCCAG (SEQ ID NO: 1014): [Model Cell line information]: cell: NCIH1563:
cancer type: LUNG: PAM dist: 5: indel length: 0: CRISPR gRNA ID: GF-CCELg9-15: [crRNA sequence]:
crRNA sequence: CTGGCAGGCTAGGGCTGGGCTGG (SEQ ID NO: 1017):
SpgRNA: attctaatacgactcactataggCTGGCAGGCTAGGGCTGGGCgttttagagctagaaatagcaagttaaaataaggctagtccgt
tatcaacttgaaaaagtggcaccgagtcggtgc (SEQ ID NO: 1018): [Target gene information]: Gene ID: 8289: Symbol:

TABLE 7-continued

Illustrative guide RNA sequences for polypeptides comprising Cas9

```
ARID1A: Ensembl Transcript ID: ENST00000324856.7: GRCh: 37: Chr: 1: [Target cancer mutation
information]: mut start: 27100949: mut end: 27100949: mut class: Nonsense Mutation: mut type: SNP: ref
seq: C: mut seq: T: mut aa: p.Q1411*: mutation info source: CCLE: ref target(-10 +10):
AGCCCAGCCCCAGCCTGCCAG (SEQ ID NO: 1013): mut target(-10 +10):
AGCCCAGCCCTAGCCTGCCAG (SEQ ID NO: 1014): [Model Cell line information]: cell: NCIH1563:
cancer type: LUNG: PAM dist: 10: indel length: 0: CRISPR gRNA ID: GF-CCELg9-16: [crRNA sequence]:
crRNA sequence: TGTTGCTGGCTGGCAGGCTAGG (SEQ ID NO: 1019):
SpgRNA: attctaatacgactcactataggTGTTGCTGGCTGGCAGGCTAgttttagagctagaaatagcaagttaaaataaggctagtccgtt
atcaacttgaaaaagtggcaccgagtcggtgc (SEQ ID NO: 1020): [Target gene information]: Gene ID: 8289: Symbol:
ARID1A: Ensembl Transcript ID: EN5T00000324856.7: GRCh: 37: Chr: 1: [Target cancer mutation
information]: mut start: 27100949: mut end: 27100949: mut class: Nonsense Mutation: mut type: SNP: ref
seq: C: mut seq: T: mut aa: p.Q1411*: mutation info source: CCLE: ref target(-10 +10):
AGCCCAGCCCCAGCCTGCCAG (SEQ ID NO: 1013): mut target(-10 +10):
AGCCCAGCCCTAGCCTGCCAG (SEQ ID NO: 1014): [Model Cell line information]: cell: NCIH1563:
cancer type: LUNG: PAM dist: 1: indel length: 0: CRISPR gRNA ID: GF-CCELg9-17: [crRNA sequence]:
crRNA sequence: CTGGCTGGCAGGCTAGGGCTGGG (SEQ ID NO: 1021):
SpgRNA: attctaatacgactcactataggCTGGCTGGCAGGCTAGGGCTgttttagagctagaaatagcaagttaaaataaggctagtccgtt
atcaacttgaaaaagtggcaccgagtcggtgc (SEQ ID NO: 1022): [Target gene information]: Gene ID: 8289: Symbol:
ARID1A: Ensembl Transcript ID: EN5T00000324856.7: GRCh: 37: Chr: 1: [Target cancer mutation
information]: mut start: 27100949: mut end: 27100949: mut class: Nonsense Mutation: mut type: SNP: ref
seq: C: mut seq: T: mut aa: p.Q1411*: mutation info source: CCLE: ref target(-10 +10):
AGCCCAGCCCCAGCCTGCCAG (SEQ ID NO: 1013): mut target(-10 +10):
AGCCCAGCCCTAGCCTGCCAG (SEQ ID NO: 1014): [Model Cell line information]: cell: NCIH1563:
cancer type: LUNG: PAM dist: 6: indel length: 0: CRISPR gRNA ID: GF-CCELg9-18: [crRNA sequence]:
crRNA sequence: TGGCAGGCTAGGGCTGGGCTGGG (SEQ ID NO: 1023):
SpgRNA: attctaatacgactcactataggTGGCAGGCTAGGGCTGGGCTgttttagagctagaaatagcaagttaaaataaggctagtccgtt
atcaacttgaaaaagtggcaccgagtcggtgc (SEQ ID NO: 1024): [Target gene information]: Gene ID: 8289: Symbol:
ARID1A: Ensembl Transcript ID: EN5T00000324856.7: GRCh: 37: Chr: 1: [Target cancer mutation
information]: mut start: 27100949: mut end: 27100949: mut class: Nonsense Mutation: mut type: SNP: ref
seq: C: mut seq: T: mut aa: p.Q1411*: mutation info source: CCLE: ref target(-10 +10):
AGCCCAGCCCCAGCCTGCCAG (SEQ ID NO: 1013): mut target(-10 +10):
AGCCCAGCCCTAGCCTGCCAG (SEQ ID NO: 1014): [Model Cell line information]: cell: NCIH1563:
cancer type: LUNG: PAM dist: 11: indel length: 0: CRISPR gRNA ID: GF-CCELg9-19: [crRNA sequence]:
crRNA sequence: GGCAGGCTAGGGCTGGGCTGGGG (SEQ ID NO: 1025):
SpgRNA: attctaatacgactcactataggGGCAGGCTAGGGCTGGGCTGgttttagagctagaaatagcaagttaaaataaggctagtccgt
tatcaacttgaaaaagtggcaccgagtcggtgc (SEQ ID NO: 1026): [Target gene information]: Gene ID: 8289: Symbol:
ARID1A: Ensembl Transcript ID: ENST00000324856.7: GRCh: 37: Chr: 1: [Target cancer mutation
information]: mut start: 27100949: mut end: 27100949: mut class: Nonsense Mutation: mut type: SNP: ref
seq: C: mut seq: T: mut aa: p.Q1411*: mutation info source: CCLE: ref target(-10 +10):
AGCCCAGCCCCAGCCTGCCAG (SEQ ID NO: 1013): mut target(-10 +10):
AGCCCAGCCCTAGCCTGCCAG (SEQ ID NO: 1014): [Model Cell line information]: cell: NCIH1563:
cancer type: LUNG: PAM dist: 12: indel length: 0: CRISPR gRNA ID: GF-CCELg9-20: [crRNA sequence]:
crRNA sequence: GCAGGCTAGGGCTGGGCTGGGGG (SEQ ID NO: 1027):
SpgRNA: attctaatacgactcactataggGCAGGCTAGGGCTGGGCTGGgttttagagctagaaatagcaagttaaaataaggctagtccgt
tatcaacttgaaaaagtggcaccgagtcggtgc (SEQ ID NO: 1028): [Target gene information]: Gene ID: 8289: Symbol:
ARID1A: Ensembl Transcript ID: EN5T00000324856.7: GRCh: 37: Chr: 1: [Target cancer mutation
information]: mut start: 27100949: mut end: 27100949: mut class: Nonsense Mutation: mut type: SNP: ref
seq: C: mut seq: T: mut aa: p.Q1411*: mutation info source: CCLE: ref target(-10 +10):
AGCCCAGCCCCAGCCTGCCAG (SEQ ID NO: 1013): mut target(-10 +10):
AGCCCAGCCCTAGCCTGCCAG (SEQ ID NO: 1014): [Model Cell line information]: cell: NCIH1563:
cancer type: LUNG: PAM dist: 13: indel length: 0: CRISPR gRNA ID: GF-CCELg9-21: [crRNA sequence]:
crRNA sequence: ACTAACTTATGAAAAGGAAGAGG (SEQ ID NO: 1029):
SpgRNA: attctaatacgactcactataggACTAACTTATGAAAAGGAAGgttttagagctagaaatagcaagttaaaataaggctagtccgt
tatcaacttgaaaaagtggcaccgagtcggtgc (SEQ ID NO: 1030): [Target gene information]: Gene ID: 8289: Symbol:
ARID1A: Ensembl Transcript ID: EN5T00000324856.7: GRCh: 37: Chr: 1: [Target cancer mutation
information]: mut start: 27106491: mut end: 27106491: mut class: Silent: mut type: SNP: ref seq: G: mut
seq: A: mut aa: p.E2034E: mutation info source: CCLE: ref target(-10 +10):
ATGAAAAGGAGGAGGAACAGG (SEQ ID NO: 1031): mut target(-10 +10):
ATGAAAAGGAAGAGGAACAGG (SEQ ID NO: 1032): [Model Cell line information]: cell: 5W1990:
cancer type: PANCREAS: PAM dist: 2: indel length: 0: CRISPR gRNA ID: GF-CCELg9-22: [crRNA
sequence]: crRNA sequence: TTTATGAAAAGGAAGAGGAACAGG (SEQ ID NO: 1033):
SpgRNA: attctaatacgactcactataggTTTATGAAAAGGAAGAGGAACgttttagagctagaaatagcaagttaaaataaggctagtccgt
tatcaacttgaaaaagtggcaccgagtcggtgc (SEQ ID NO: 1034): [Target gene information]: Gene ID: 8289: Symbol:
ARID1A: Ensembl Transcript ID: EN5T00000324856.7: GRCh: 37: Chr: 1: [Target cancer mutation
information]: mut start: 27106491: mut end: 27106491: mut class: Silent: mut type: SNP: ref seq: G: mut
seq: A: mut aa: p.E2034E: mutation info source: CCLE: ref target(-10 +10):
ATGAAAAGGAGGAGGAACAGG (SEQ ID NO: 1031): mut target(-10 +10)
ATGAAAAGGAAGAGGAACAGG (SEQ ID NO: 1032): [Model Cell line information]: cell: SW1990
cancer type: PANCREAS: PAM dist: 8: indel length: 0: CRISPR gRNA ID: GF-CCELg9-23: [crRNA
sequence]: crRNA sequence: AAGGAAGAGGAACAGGACCAAGG (SEQ ID NO: 1035)
SpgRNA: attctaatacgactcactataggAAGGAAGAGGAACAGGACCAAGGACCgttttagagctagaaatagcaagttaaaataaggctagtccg
ttatcaacttgaaaaagtggcaccgagtcggtgc (SEQ ID NO: 1036): [Target gene information]: Gene ID: 8289
Symbol: ARID1A: Ensembl Transcript ID: EN5T00000324856.7: GRCh: 37: Chr: 1: [Target cancer mutatior
information]: mut start: 27106491: mut end: 27106491: mut class: Silent: mut type: SNP: ref seq: G: mu
seq: A: mut aa: p.E2034E: mutation info source: CCLE: ref target(-10 +10)
ATGAAAAGGAGGAGGAACAGG (SEQ ID NO: 1031): mut target(-10 +10)
```

TABLE 7-continued

Illustrative guide RNA sequences for polypeptides comprising Cas9

ATGAAAAGGAAGAGGAACAGG (SEQ ID NO: 1032): [Model Cell line information]: cell: 5W1990
cancer type: PANCREAS: PAM dist: 15: indel length: 0: CRISPR gRNA ID: GF-CCELg9-24: [crRNA
sequence]: crRNA sequence: AGGAAGAGGAACAGGACCAAGGG (SEQ ID NO: 1037)
SpgRNA: attctaatacgactcactataggAGGAAGAGGAACAGGACCAAGgttttagagctagaaatagcaagttaaaataaggctagtccg
ttatcaacttgaaaaagtggcaccgagtcggtgc (SEQ ID NO: 1038): [Target gene information]: Gene ID: 8289
Symbol: ARID1A: Ensembl Transcript ID: EN5T00000324856.7: GRCh: 37: Chr: 1: [Target cancer mutatior
information]: mut start: 27106491: mut end: 27106491: mut class: Silent: mut type: SNP: ref seq: G: mu
seq: A: mut aa: p.E2034E: mutation info source: CCLE: ref target(-10 +10)
ATGAAAAGGAGGAGGAACAGG (SEQ ID NO: 1031): mut target(-10 +10)
ATGAAAAGGAAGAGGAACAGG (SEQ ID NO: 1032): [Model Cell line information]: cell: 5W1990
cancer type: PANCREAS: PAM dist: 16: indel length: 0: CRISPR gRNA ID: GF-CCELg9-25: [crRNA
sequence]: crRNA sequence: GGAAGAGGAACAGGACCAAGGGG (SEQ ID NO: 1039)
SpgRNA: attctaatacgactcactataggGGAAGAGGAACAGGACCAAGgttttagagctagaaatagcaagttaaaataaggctagtccg
ttatcaacttgaaaaagtggcaccgagtcggtgc (SEQ ID NO: 1040): [Target gene information]: Gene ID: 8289
Symbol: ARID1A: Ensembl Transcript ID: EN5T00000324856.7: GRCh: 37: Chr: 1: [Target cancer mutatior
information]: mut start: 27106491: mut end: 27106491: mut class: Silent: mut type: SNP: ref seq: G: mu
seq: A: mut aa: p.E2034E: mutation info source: CCLE: ref target(-10 +10)
ATGAAAAGGAGGAGGAACAGG (SEQ ID NO: 1031): mut target(-10 +10)
ATGAAAAGGAAGAGGAACAGG (SEQ ID NO: 1032): [Model Cell line information]: cell: 5W1990
cancer type: PANCREAS: PAM dist: 17: indel length: 0: CRISPR gRNA ID: GF-CCELg9-26: [crRNA
sequence]: crRNA sequence: TCTTCCTTTTCATAAGTTAGTGG (SEQ ID NO: 1041)
SpgRNA: attctaatacgactcactataggTCTTCCTTTTCATAAGTTAGgttttagagctagaaatagcaagttaaaataaggctagtccgtta
tcaacttgaaaaagtggcaccgagtcggtgc (SEQ ID NO: 1042): [Target gene information]: Gene ID: 8289: Symbol
ARID1A: Ensembl Transcript ID: ENST00000324856.7: GRCh: 37: Chr: 1: [Target cancer mutation
information]: mut start: 27106491: mut end: 27106491: mut class: Silent: mut type: SNP: ref seq: G: mut
seq: A: mut aa: p.E2034E: mutation info source: CCLE: ref target(-10 +10):
ATGAAAAGGAGGAGGAACAGG (SEQ ID NO: 1031): mut target(-10 +10):
ATGAAAAGGAAGAGGAACAGG (SEQ ID NO: 1032): [Model Cell line information]: cell: 5W1990:
cancer type: PANCREAS: PAM dist: 18: indel length: 0: CRISPR gRNA ID: GF-CCELg9-27: [crRNA
sequence]: crRNA sequence: CCAGGACAACAATGTGGACCTGG (SEQ ID NO: 1043):
SpgRNA: attctaatacgactcactataggCCAGGACAACAATGTGGACCgttttagagctagaaatagcaagttaaaataaggctagtccgt
tatcaacttgaaaaagtggcaccgagtcggtgc (SEQ ID NO: 1044): [Target gene information]: Gene ID: 8289: Symbol:
ARID1A: Ensembl Transcript ID: EN5T00000324856.7: GRCh: 37: Chr: 1: [Target cancer mutation
information]: mut start: 27106789: mut end: 27106794: mut class: In Frame Del: mut type: DEL: ref seq:
CTGATT: mut seq: -: mut aa: p.LI2134del: mutation info source: CCLE: ref target(-10 +10):
CAATGTGGACCTGATTCTGGCCACAC (SEQ ID NO: 1045): mut target(-10 +10): CAATGTGGAC------
CTGGCCACAC (SEQ ID NO: 1046): [Model Cell line information]: cell: NCIH460: cancer type: LUNG:
PAM dist: 2: indel length: 6: CRISPR gRNA ID: GF-CCELg9-28: [crRNA sequence]: crRNA sequence:
GGCTGAAGGGGGGTGTGGCAGG (SEQ ID NO: 1047):
SpgRNA: attctaatacgactcactataggGGCTGAAGGGGGGTGTGGCCgttttagagctagaaatagcaagttaaaataaggctagtccgt
tatcaacttgaaaaagtggcaccgagtcggtgc (SEQ ID NO: 1048): [Target gene information]: Gene ID: 8289: Symbol:
ARID1A: Ensembl Transcript ID: EN5T00000324856.7: GRCh: 37: Chr: 1: [Target cancer mutation
information]: mut start: 27106789: mut end: 27106794: mut class: In Frame Del: mut type: DEL: ref seq:
CTGATT: mut seq: -: mut aa: p.LI2134del: mutation info source: CCLE: ref target(-10 +10):
CAATGTGGACCTGATTCTGGCCACAC (SEQ ID NO: 1045): mut target(-10 +10): CAATGTGGAC------
CTGGCCACAC (SEQ ID NO: 1046): [Model Cell line information]: cell: NCIH460: cancer type: LUNG:
PAM dist: -1: indel length: 6: CRISPR gRNA ID: GF-CCELg9-29: [crRNA sequence]: crRNA sequence:
CCAGGTCCACATTGTTGTCCTGG (SEQ ID NO: 1049):
SpgRNA: attctaatacgactcactataggCCAGGTCCACATTGTTGTCCgttttagagctagaaatagcaagttaaaataaggctagtccgtt
atcaacttgaaaaagtggcaccgagtcggtgc (SEQ ID NO: 1050): [Target gene information]: Gene ID: 8289: Symbol:
ARID1A: Ensembl Transcript ID: EN5T00000324856.7: GRCh: 37: Chr: 1: [Target cancer mutation
information]: mut start: 27106789: mut end: 27106794: mut class: In Frame Del: mut type: DEL: ref seq:
CTGATT: mut seq: -: mut aa: p.LI2134del: mutation info source: CCLE: ref target(-10 +10):
CAATGTGGACCTGATTCTGGCCACAC (SEQ ID NO: 1045): mut target(-10 +10): CAATGTGGAC------
CTGGCCACAC (SEQ ID NO: 1046): [Model Cell line information]: cell: NCIH460: cancer type: LUNG:
PAM dist: 17: indel length: 6: CRISPR gRNA ID: GF-CCELg9-30: [crRNA sequence]: crRNA sequence:
GGAGGAAAAGATGTATGTCCAGG (SEQ ID NO: 1051):
SpgRNA: attctaatacgactcactataggGGAGGAAAAGATGTATGTCCgttttagagctagaaatagcaagttaaaataaggctagtccgt
tatcaacttgaaaaagtggcaccgagtcggtgc (SEQ ID NO: 1052): [Target gene information]: Gene ID: 196528:
Symbol: ARID2: Ensembl Transcript ID: EN5T00000334344.6: GRCh: 37: Chr: 12: [Target cancer mutation
information]: mut start: 46285628: mut end: 46285628: mut class: Missense Mutation: mut type: SNP: ref
seq: A: mut seq: G: mut aa: p.Y1663C: mutation info source: CCLE: ref target(-10 +10):
AAAGATGTATATCCAGGGCAG (SEQ ID NO: 1053): mut target(-10 +10):
AAAGATGTATGTCCAGGGCAG (SEQ ID NO: 1054): [Model Cell line information]: cell: NCIH2126:
cancer type: LUNG: PAM dist: 4: indel length: 0: CRISPR gRNA ID: GF-CCELg9-31: [crRNA sequence]:
crRNA sequence: TATGTCCAGGGCAGTGTCTTGG (SEQ ID NO: 1055):
SpgRNA: attctaatacgactcactataggTATGTCCAGGGCAGTGTCTTgttttagagctagaaatagcaagttaaaataaggctagtccgtt
atcaacttgaaaaagtggcaccgagtcggtgc (SEQ ID NO: 1056): [Target gene information]: Gene ID: 196528:
Symbol: ARID2: Ensembl Transcript ID: EN5T00000334344.6: GRCh: 37: Chr: 12: [Target cancer mutation
information]: mut start: 46285628: mut end: 46285628: mut class: Missense Mutation: mut type: SNP: ref
seq: A: mut seq: G: mut aa: p.Y1663C: mutation info source: CCLE: ref target(-10 +10):
AAAGATGTATATCCAGGGCAG (SEQ ID NO: 1053): mut target(-10 +10):
AAAGATGTATGTCCAGGGCAG (SEQ ID NO: 1054): [Model Cell line information]: cell: NCIH2126:
cancer type: LUNG: PAM dist: 17: indel length: 0: CRISPR gRNA ID: GF-CCELg9-32: [crRNA sequence]:
crRNA sequence: GAGGAAAAGATGTATGTCCAGGG (SEQ ID NO: 1057):
SpgRNA: attctaatacgactcactataggGAGGAAAAGATGTATGTCCAgttttagagctagaaatagcaagttaaaataaggctagtccgt
tatcaacttgaaaaagtggcaccgagtcggtgc (SEQ ID NO: 1058): [Target gene information]: Gene ID: 196528:
Symbol: ARID2: Ensembl Transcript ID: EN5T00000334344.6: GRCh: 37: Chr: 12: [Target cancer mutation TABLE 7-continued Illustrative guide RNA sequences for polypeptides comprising Cas9 information]: mut start: 46285628: mut end: 46285628: mut class: Missense Mutation: mut type: SNP: ref
seq: A: mut seq: G: mut aa: p.Y1663C: mutation info source: CCLE: ref target(-10 +10):
AAAGATGTATATCCAGGGCAG (SEQ ID NO: 1053): mut target(-10 +10):
AAAGATGTATGTCCAGGGCAG (SEQ ID NO: 1054): [Model Cell line information]: cell: NCIH2126:
cancer type: LUNG: PAM dist: 5: indel length: 0: CRISPR gRNA ID: GF-CCELg9-33: [crRNA sequence]:
crRNA sequence: ATGTCCAGGGCAGTGTCTTTGGG (SEQ ID NO: 1059):
SpgRNA: attctaatacgactcactataggATGTCCAGGGCAGTGTCTTTgttttagagctagaaatagcaagttaaaataaggctagtccgtt
atcaacttgaaaaagtggcaccgagtcggtgc (SEQ ID NO: 1060): [Target gene information]: Gene ID: 196528:
Symbol: ARID2: Ensembl Transcript ID: EN5T00000334344.6: GRCh: 37: Chr: 12: [Target cancer mutation
information]: mut start: 46285628: mut end: 46285628: mut class: Missense Mutation: mut type: SNP: ref
seq: A: mut seq: G: mut aa: p.Y1663C: mutation info source: CCLE: ref target(-10 +10):
AAAGATGTATATCCAGGGCAG (SEQ ID NO: 1053): mut target(-10 +10):
AAAGATGTATGTCCAGGGCAG (SEQ ID NO: 1054): [Model Cell line information]: cell: NCIH2126:
cancer type: LUNG: PAM dist: 18: indel length: 0: CRISPR gRNA ID: GF-CCELg9-34: [crRNA sequence]:
crRNA sequence: GCACAAACTCCATGTCTGGTAGG (SEQ ID NO: 1061):
SpgRNA: attctaatacgactcactataggGCACAAACTCCATGTCTGGTgttttagagctagaaatagcaagttaaaataaggctagtccgtt
atcaacttgaaaaagtggcaccgagtcggtgc (SEQ ID NO: 1062): [Target gene information]: Gene ID: 171023:
Symbol: ASXL1: Ensembl Transcript ID: EN5T00000375687.4: GRCh: 37: Chr: 20: [Target cancer mutation
information]: mut start: 31024557: mut end: 31024557: mut class: Missense Mutation: mut type: SNP: ref
seq: G: mut seq: A: mut aa: p.G1348R: mutation info source: CCLE: ref target(-10 +10):
CATGTCTGGTGGGGTACAGAC (SEQ ID NO: 1063): mut target(-10 +10):
CATGTCTGGTAGGGTACAGAC (SEQ ID NO: 1064): [Model Cell line information]: cell: NCIH1299:
cancer type: LUNG: PAM dist: 0: indel length: 0: CRISPR gRNA ID: GF-CCELg9-35: [crRNA sequence]:
crRNA sequence: CTGGTAGGGTACAGACTCCAAGG (SEQ ID NO: 1065):
SpgRNA: attctaatacgactcactataggCTGGTAGGGTACAGACTCCAgttttagagctagaaatagcaagttaaaataaggctagtccgtt
atcaacttgaaaaagtggcaccgagtcggtgc (SEQ ID NO: 1066): [Target gene information]: Gene ID: 171023:
Symbol: ASXL1: Ensembl Transcript ID: EN5T00000375687.4: GRCh: 37: Chr: 20: [Target cancer mutation
information]: mut start: 31024557: mut end: 31024557: mut class: Missense Mutation: mut type: SNP: ref
seq: G: mut seq: A: mut aa: p.G1348R: mutation info source: CCLE: ref target(-10 +10):
CATGTCTGGTGGGGTACAGAC (SEQ ID NO: 1063): mut target(-10 +10):
CATGTCTGGTAGGGTACAGAC (SEQ ID NO: 1064): [Model Cell line information]: cell: NCIH1299:
cancer type: LUNG: PAM dist: 15: indel length: 0: CRISPR gRNA ID: GF-CCELg9-36: [crRNA sequence]:
crRNA sequence: CACAAACTCCATGTCTGGTAGGG (SEQ ID NO: 1067):
SpgRNA: attctaatacgactcactataggCACAAACTCCATGTCTGGTAgttttagagctagaaatagcaagttaaaataaggctagtccgtt
atcaacttgaaaaagtggcaccgagtcggtgc (SEQ ID NO: 1068): [Target gene information]: Gene ID: 171023:
Symbol: ASXL1: Ensembl Transcript ID: EN5T00000375687.4: GRCh: 37: Chr: 20: [Target cancer mutation
information]: mut start: 31024557: mut end: 31024557: mut class: Missense Mutation: mut type: SNP: ref
seq: G: mut seq: A: mut aa: p.G1348R: mutation info source: CCLE: ref target(-10 +10):
CATGTCTGGTGGGGTACAGAC (SEQ ID NO: 1063): mut target(-10 +10):
CATGTCTGGTAGGGTACAGAC (SEQ ID NO: 1064): [Model Cell line information]: cell: NCIH1299:
cancer type: LUNG: PAM dist: 1: indel length: 0: CRISPR gRNA ID: GF-CCELg9-37: [crRNA sequence]:
crRNA sequence: TGGTAGGGTACAGACTCCAAGGG (SEQ ID NO: 1069):
SpgRNA: attctaatacgactcactataggTGGTAGGGTACAGACTCCAAgttttagagctagaaatagcaagttaaaataaggctagtccgtt
atcaacttgaaaaagtggcaccgagtcggtgc (SEQ ID NO: 1070): [Target gene information]: Gene ID: 171023:
Symbol: ASXL1: Ensembl Transcript ID: EN5T00000375687.4: GRCh: 37: Chr: 20: [Target cancer mutation
information]: mut start: 31024557: mut end: 31024557: mut class: Missense Mutation: mut type: SNP: ref
seq: G: mut seq: A: mut aa: p.G1348R: mutation info source: CCLE: ref target(-10 +10):
CATGTCTGGTGGGGTACAGAC (SEQ ID NO: 1063): mut target(-10 +10):
CATGTCTGGTAGGGTACAGAC (SEQ ID NO: 1064): [Model Cell line information]: cell: NCIH1299:
cancer type: LUNG: PAM dist: 16: indel length: 0: CRISPR gRNA ID: GF-CCELg9-38: [crRNA sequence]:
crRNA sequence: AGTCTGTACCCTACCAGACATGG (SEQ ID NO: 1071):
SpgRNA: attctaatacgactcactataggAGTCTGTACCCTACCAGACAgttttagagctagaaatagcaagttaaaataaggctagtccgtt
atcaacttgaaaaagtggcaccgagtcggtgc (SEQ ID NO: 1072): [Target gene information]: Gene ID: 171023:
Symbol: ASXL1: Ensembl Transcript ID: EN5T00000375687.4: GRCh: 37: Chr: 20: [Target cancer mutation
information]: mut start: 31024557: mut end: 31024557: mut class: Missense Mutation: mut type: SNP: ref
seq: G: mut seq: A: mut aa: p.G1348R: mutation info source: CCLE: ref target(-10 +10):
CATGTCTGGTGGGGTACAGAC (SEQ ID NO: 1063): mut target(-10 +10):
CATGTCTGGTAGGGTACAGAC (SEQ ID NO: 1064): [Model Cell line information]: cell: NCIH1299:
cancer type: LUNG: PAM dist: 9: indel length: 0: CRISPR gRNA ID: GF-CCELg9-39: [crRNA sequence]:
crRNA sequence: GTGTTGACAATAATGGACCCAGG (SEQ ID NO: 1073):
SpgRNA: attctaatacgactcactataggGTGTTGACAATAATGGACCCgttttagagctagaaatagcaagttaaaataaggctagtccgtt
atcaacttgaaaaagtggcaccgagtcggtgc (SEQ ID NO: 1074): [Target gene information]: Gene ID: 171023:
Symbol: ASXL1: Ensembl Transcript ID: EN5T00000375687.4: GRCh: 37: Chr: 20: [Target cancer mutation
information]: mut start: 31019180: mut end: 31019180: mut class: Missense Mutation: mut type: SNP: ref
seq: C: mut seq: A: mut aa: p.L259I: mutation info source: CCLE: ref target(-10 +10):
TGGGTCCATTCTTGTCAACAC (SEQ ID NO: 136): mut target(-10 +10):
TGGGTCCATTATTGTCAACAC (SEQ ID NO: 137): [Model Cell line information]: cell: NCIH1573:
cancer type: LUNG: PAM dist: 10: indel length: 0: CRISPR gRNA ID: GF-CCELg9-40: [crRNA sequence]:
crRNA sequence: GAGGTTGGTGTTGACAATAATGG (SEQ ID NO: 1075):
SpgRNA: attctaatacgactcactataggGAGGTTGGTGTTGACAATAAgttttagagctagaaatagcaagttaaaataaggctagtccgtt
atcaacttgaaaaagtggcaccgagtcggtgc (SEQ ID NO: 1076): [Target gene information]: Gene ID: 171023:
Symbol: ASXL1: Ensembl Transcript ID: EN5T00000375687.4: GRCh: 37: Chr: 20: [Target cancer mutation
information]: mut start: 31019180: mut end: 31019180: mut class: Missense Mutation: mut type: SNP: ref
seq: C: mut seq: A: mut aa: p.L259I: mutation info source: CCLE: ref target(-10 +10):
TGGGTCCATTCTTGTCAACAC (SEQ ID NO: 136): mut target(-10 +10):
TGGGTCCATTATTGTCAACAC (SEQ ID NO: 137): [Model Cell line information]: cell: NCIH1573:
cancer type: LUNG: PAM dist: 3: indel length: 0: CRISPR gRNA ID: GF-CCELg9-41: [crRNA sequence]:
crRNA sequence: AAAGTCCCGCCCATTTCGGTAGG (SEQ ID NO: 1077):

TABLE 7-continued

Illustrative guide RNA sequences for polypeptides comprising Cas9

SpgRNA: attctaatacgactcactataggAAAGTCCCGCCCATTCGGTgttttagagctagaaatagcaagttaaaataaggctagtccgtt
atcaacttgaaaaagtggcaccgagtcggtgc (SEQ ID NO: 1078): [Target gene information]: Gene ID: 171023:
Symbol: ASXL1: Ensembl Transcript ID: ENST00000375687.4: GRCh: 37: Chr: 20: [Target cancer mutation
information]: mut start: 31021717: mut end: 31021717: mut class: Silent: mut type: SNP: ref seq: C: mut
seq: T: mut aa: p.I572I: mutation info source: CCLE: ref target(-10 +10): TCCCGCCCATC̲CGGGTAGGAG
(SEQ ID NO: 1079): mut target(-10 +10): TCCCGCCCATT̲CGGGTAGGAG (SEQ ID NO: 1080):
[Model Cell line information]: cell: NCIH1573: cancer type: LUNG: PAM dist: 6: indel length: 0: CRISPR
gRNA ID: GF-CCELg9-42: [crRNA sequence]: crRNA sequence: AGCCCAAAGTCCCGCCCATT̲CGG
(SEQ ID NO: 1081):
SpgRNA: attctaatacgactcactataggAGCCCAAAGTCCCGCCCATTgttttagagctagaaatagcaagttaaaataaggctagtccgtt
atcaacttgaaaaagtggcaccgagtcggtgc (SEQ ID NO: 1082): [Target gene information]: Gene ID: 171023:
Symbol: ASXL1: Ensembl Transcript ID: EN5T00000375687.4: GRCh: 37: Chr: 20: [Target cancer mutation
information]: mut start: 31021717: mut end: 31021717: mut class: Silent: mut type: SNP: ref seq: C: mut
seq: T: mut aa: p.I572I: mutation info source: CCLE: ref target(-10 +10): TCCCGCCCATC̲CGGGTAGGAG
(SEQ ID NO: 1079): mut target(-10 +10): TCCCGCCCATT̲CGGGTAGGAG (SEQ ID NO: 1080):
[Model Cell line information]: cell: NCIH1573: cancer type: LUNG: PAM dist: 1: indel length: 0: CRISPR
gRNA ID: GF-CCELg9-43: [crRNA sequence]: crRNA sequence: GCCCAAAGTCCCGCCCATT̲CGGG
(SEQ ID NO: 1083):
SpgRNA: attctaatacgactcactataggGCCCAAAGTCCCGCCCATTCgttttagagctagaaatagcaagttaaaataaggctagtccgtt
atcaacttgaaaaagtggcaccgagtcggtgc (SEQ ID NO: 1084): [Target gene information]: Gene ID: 171023:
Symbol: ASXL1: Ensembl Transcript ID: EN5T00000375687.4: GRCh: 37: Chr: 20: [Target cancer mutation
information]: mut start: 31021717: mut end: 31021717: mut class: Silent: mut type: SNP: ref seq: C: mut
seq: T: mut aa: p.I572I: mutation info source: CCLE: ref target(-10 +10): TCCCGCCCATC̲CGGGTAGGAG
(SEQ ID NO: 1079): mut target(-10 +10): TCCCGCCCATT̲CGGGTAGGAG (SEQ ID NO: 1080):
[Model Cell line information]: cell: NCIH1573: cancer type: LUNG: PAM dist: 2: indel length: 0: CRISPR
gRNA ID: GF-CCELg9-44: [crRNA sequence]: crRNA sequence: CAAACAGTCTCCTACCCGA̲ATGG
(SEQ ID NO: 1085):
SpgRNA: attctaatacgactcactataggCAAACAGTCTCCTACCCGAAgttttagagctagaaatagcaagttaaaataaggctagtccgtt
atcaacttgaaaaagtggcaccgagtcggtgc (SEQ ID NO: 1086): [Target gene information]: Gene ID: 171023:
Symbol: ASXL1: Ensembl Transcript ID: EN5T00000375687.4: GRCh: 37: Chr: 20: [Target cancer mutation
information]: mut start: 31021717: mut end: 31021717: mut class: Silent: mut type: SNP: ref seq: C: mut
seq: T: mut aa: p.I572I: mutation info source: CCLE: ref target(-10 +10): TCCCGCCCATC̲CGGGTAGGAG
(SEQ ID NO: 1079): mut target(-10 +10): TCCCGCCCATTCGGGTAGGAG (SEQ ID NO: 1080):
[Model Cell line information]: cell: NCIH1573: cancer type: LUNG: PAM dist: 2: indel length: 0: CR1SPR
gRNA ID: GF-CCELg9-45: [crRNA sequence]: crRNA sequence: TACCCGA̲ATGGGCGGGACTTTGG
(SEQ ID NO: 1087):
SpgRNA: attctaatacgactcactataggTACCCGAATGGGCGGGACTTgttttagagctagaaatagcaagttaaaataaggctagtccgtt
atcaacttgaaaaagtggcaccgagtcggtgc (SEQ ID NO: 1088): [Target gene information]: Gene ID: 171023:
Symbol: ASXL1: Ensembl Transcript ID: EN5T00000375687.4: GRCh: 37: Chr: 20: [Target cancer mutation
information]: mut start: 31021717: mut end: 31021717: mut class: Silent: mut type: SNP: ref seq: C: mut
seq: T: mut aa: p.I572I: mutation info source: CCLE: ref target(-10 +10): TCCCGCCCATC̲CGGGTAGGAG
(SEQ ID NO: 1079): mut target(-10 +10): TCCCGCCCATT̲CGGGTAGGAG (SEQ ID NO: 1080):
[Model Cell line information]: cell: NCIH1573: cancer type: LUNG: PAM dist: 14: indel length: 0: CR1SPR
gRNA ID: GF-CCELg9-46: [crRNA sequence]: crRNA sequence: CAGTCTCCTACCCGA̲ATGGGCGG
(SEQ ID NO: 1089):
SpgRNA: attctaatacgactcactataggCAGTCTCCTACCCGAATGGGgttttagagctagaaatagcaagttaaaataaggctagtccgtt
atcaacttgaaaaagtggcaccgagtcggtgc (SEQ ID NO: 1090): [Target gene information]: Gene ID: 171023:
Symbol: ASXL1: Ensembl Transcript ID: EN5T00000375687.4: GRCh: 37: Chr: 20: [Target cancer mutation
information]: mut start: 31021717: mut end: 31021717: mut class: Silent: mut type: SNP: ref seq: C: mut
seq: T: mut aa: p.I572I: mutation info source: CCLE: ref target(-10 +10): TCCCGCCCATC̲CGGGTAGGAG
(SEQ ID NO: 1079): mut target(-10 +10): TCCCGCCCATT̲CGGGTAGGAG (SEQ ID NO: 1080):
[Model Cell line information]: cell: NCIH1573: cancer type: LUNG: PAM dist: 6: indel length: 0: CR1SPR
gRNA ID: GF-CCELg9-47: [crRNA sequence]: crRNA sequence: AAACAGTCTCCTACCCGA̲ATGGG
(SEQ ID NO: 1091):
SpgRNA: attctaatacgactcactataggAAACAGTCTCCTACCCGAATgttttagagctagaaatagcaagttaaaataaggctagtccgtt
atcaacttgaaaaagtggcaccgagtcggtgc (SEQ ID NO: 1092): [Target gene information]: Gene ID: 171023:
Symbol: ASXL1: Ensembl Transcript ID: EN5T00000375687.4: GRCh: 37: Chr: 20: [Target cancer mutation
information]: mut start: 31021717: mut end: 31021717: mut class: Silent: mut type: SNP: ref seq: C: mut
seq: T: mut aa: p.I572I: mutation info source: CCLE: ref target(-10 +10): TCCCGCCCATC̲CGGGTAGGAG
(SEQ ID NO: 1079): mut target(-10 +10): TCCCGCCCATT̲CGGGTAGGAG (SEQ ID NO: 1080):
[Model Cell line information]: cell: NCIH1573: cancer type: LUNG: PAM dist: 3: indel length: 0: CR1SPR
gRNA ID: GF-CCELg9-48: [crRNA sequence]: crRNA sequence: AGTCTCCTACCCGA̲ATGGGCGGG
(SEQ ID NO: 1093):
SpgRNA: attctaatacgactcactataggAGTCTCCTACCCGAATGGGCgttttagagctagaaatagcaagttaaaataaggctagtccgtt
atcaacttgaaaaagtggcaccgagtcggtgc (SEQ ID NO: 1094): [Target gene information]: Gene ID: 171023:
Symbol: ASXL1: Ensembl Transcript ID: EN5T00000375687.4: GRCh: 37: Chr: 20: [Target cancer mutation
information]: mut start: 31021717: mut end: 31021717: mut class: Silent: mut type: SNP: ref seq: C: mut
seq: T: mut aa: p.I572I: mutation info source: CCLE: ref target(-10 +10): TCCCGCCCATCCGGGTAGGAG
(SEQ ID NO: 1079): mut target(-10 +10): TCCCGCCCATTCGGGTAGGAG (SEQ ID NO: 1080):
[Model Cell line information]: cell: NCIH1573: cancer type: LUNG: PAM dist: 7: indel length: 0: CRISPR
gRNA ID: GF-CCELg9-49: [crRNA sequence]: crRNA sequence: ACCCGA̲ATGGGCGGGACTTTGGG
(SEQ ID NO: 1095):
SpgRNA: attctaatacgactcactataggACCCGAATGGGCGGGACTTTgttttagagctagaaatagcaagttaaaataaggctagtccgtt
atcaacttgaaaaagtggcaccgagtcggtgc (SEQ ID NO: 1096): [Target gene information]: Gene ID: 171023:
Symbol: ASXL1: Ensembl Transcript ID: EN5T00000375687.4: GRCh: 37: Chr: 20: [Target cancer mutation
information]: mut start: 31021717: mut end: 31021717: mut class: Silent: mut type: SNP: ref seq: C: mut
seq: T: mut aa: p.I572I: mutation info source: CCLE: ref target(-10 +10): TCCCGCCCATCCGGGTAGGAG
(SEQ ID NO: 1079): mut target(-10 +10): TCCCGCCCATTCGGGTAGGAG (SEQ ID NO: 1080):

TABLE 7-continued

Illustrative guide RNA sequences for polypeptides comprising Cas9

[Model Cell line information]: cell: NCIH1573: cancer type: LUNG: PAM dist: 15: indel length: 0: CRISPR gRNA ID: GF-CCELg9-50: [crRNA sequence]: crRNA sequence: AAAGTCCCGCCCATCTGGGTAGG (SEQ ID NO: 1097):
SpgRNA: attctaatacgactcactataggAAAGTCCCGCCCATCTGGGTgttttagagctagaaatagcaagttaaaataaggctagtccgtt atcaacttgaaaaagtggcaccgagtcggtgc (SEQ ID NO: 1098): [Target gene information]: Gene ID: 171023: Symbol: ASXL1: Ensembl Transcript ID: EN5T00000375687.4: GRCh: 37: Chr: 20: [Target cancer mutation information]: mut start: 31021718: mut end: 31021718: mut class: Missense Mutation: mut type: SNP: ref seq: C: mut seq: T: mut aa: p.R573W: mutation info source: CCLE: ref target(-10 +10): CCCGCCCATCCGGGTAGGAGA (SEQ ID NO: 1099): mut target(-10 +10): CCCGCCCATCTGGGTAGGAGA (SEQ ID NO: 1100): [Model Cell line information]: cell: NCIH1573: cancer type: LUNG: PAM dist: 5: indel length: 0: CRISPR gRNA ID: GF-CCELg9-51: [crRNA sequence]: crRNA sequence: AGCCCAAAGTCCCGCCCATCTGG (SEQ ID NO: 1101):
SpgRNA: attctaatacgactcactataggAGCCCAAAGTCCCGCCCATCgttttagagctagaaatagcaagttaaaataaggctagtccgtt atcaacttgaaaaagtggcaccgagtcggtgc (SEQ ID NO: 1102): [Target gene information]: Gene ID: 171023: Symbol: ASXL1: Ensembl Transcript ID: EN5T00000375687.4: GRCh: 37: Chr: 20: [Target cancer mutation information]: mut start: 31021718: mut end: 31021718: mut class: Missense Mutation: mut type: SNP: ref seq: C: mut seq: T: mut aa: p.R573W: mutation info source: CCLE: ref target(-10 +10): CCCGCCCATCCGGGTAGGAGA (SEQ ID NO: 1099): mut target(-10 +10): CCCGCCCATCTGGGTAGGAGA (SEQ ID NO: 1100): [Model Cell line information]: cell: NCIH1573: cancer type: LUNG: PAM dist: 0: indel length: 0: CRISPR gRNA ID: GF-CCELg9-52: [crRNA sequence]: crRNA sequence: GCCCAAAGTCCCGCCCATCTGGG (SEQ ID NO: 1103):
SpgRNA: attctaatacgactcactataggGCCCAAAGTCCCGCCCATCTgttttagagctagaaatagcaagttaaaataaggctagtccgtt atcaacttgaaaaagtggcaccgagtcggtgc (SEQ ID NO: 1104): [Target gene information]: Gene ID: 171023: Symbol: ASXL1: Ensembl Transcript ID: ENST00000375687.4: GRCh: 37: Chr: 20: [Target cancer mutation information]: mut start: 31021718: mut end: 31021718: mut class: Missense Mutation: mut type: SNP: ref seq: C: mut seq: T: mut aa: p.R573W: mutation info source: CCLE: ref target(-10 +10): CCCGCCCATCCGGGTAGGAGA (SEQ ID NO: 1099): mut target(-10 +10): CCCGCCCATCTGGGTAGGAGA (SEQ ID NO: 1100): [Model Cell line information]: cell: NCIH1573: cancer type: LUNG: PAM dist: 1: indel length: 0: CRISPR gRNA ID: GF-CCELg9-53: [crRNA sequence]: crRNA sequence: CAAACAGTCTCCTACCCAGATGG (SEQ ID NO: 1105):
SpgRNA: attctaatacgactcactataggCAAACAGTCTCCTACCCAGAgttttagagctagaaatagcaagttaaaataaggctagtccgtt atcaacttgaaaaagtggcaccgagtcggtgc (SEQ ID NO: 1106): [Target gene information]: Gene ID: 171023: Symbol: ASXL1: Ensembl Transcript ID: EN5T00000375687.4: GRCh: 37: Chr: 20: [Target cancer mutation information]: mut start: 31021718: mut end: 31021718: mut class: Missense Mutation: mut type: SNP: ref seq: C: mut seq: T: mut aa: p.R573W: mutation info source: CCLE: ref target(-10 +10): CCCGCCCATCCGGGTAGGAGA (SEQ ID NO: 1099): mut target(-10 +10): CCCGCCCATCTGGGTAGGAGA (SEQ ID NO: 1100): [Model Cell line information]: cell: NCIH1573: cancer type: LUNG: PAM dist: 3: indel length: 0: CRISPR gRNA ID: GF-CCELg9-54: [crRNA sequence]: crRNA sequence: TACCCAGATGGGCGGGACTTTGG (SEQ ID NO: 1107):
SpgRNA: attctaatacgactcactataggTACCCAGATGGGCGGGACTTTgttttagagctagaaatagcaagttaaaataaggctagtccgtt atcaacttgaaaaagtggcaccgagtcggtgc (SEQ ID NO: 1108): [Target gene information]: Gene ID: 171023: Symbol: ASXL1: Ensembl Transcript ID: EN5T00000375687.4: GRCh: 37: Chr: 20: [Target cancer mutation information]: mut start: 31021718: mut end: 31021718: mut class: Missense Mutation: mut type: SNP: ref seq: C: mut seq: T: mut aa: p.R573W: mutation info source: CCLE: ref target(-10 +10): CCCGCCCATCCGGGTAGGAGA (SEQ ID NO: 1099): mut target(-10 +10): CCCGCCCATCTGGGTAGGAGA (SEQ ID NO: 1100): [Model Cell line information]: cell: NCIH1573: cancer type: LUNG: PAM dist: 15: indel length: 0: CRISPR gRNA ID: GF-CCELg9-55: [crRNA sequence]: crRNA sequence: CAGTCTCCTACCCAGATGGGCGG (SEQ ID NO: 1109):
SpgRNA: attctaatacgactcactataggCAGTCTCCTACCCAGATGGGgttttagagctagaaatagcaagttaaaataaggctagtccgtt atcaacttgaaaaagtggcaccgagtcggtgc (SEQ ID NO: 1110): [Target gene information]: Gene ID: 171023: Symbol: ASXL1: Ensembl Transcript ID: EN5T00000375687.4: GRCh: 37: Chr: 20: [Target cancer mutation information]: mut start: 31021718: mut end: 31021718: mut class: Missense Mutation: mut type: SNP: ref seq: C: mut seq: T: mut aa: p.R573W: mutation info source: CCLE: ref target(-10 +10): CCCGCCCATCCGGGTAGGAGA (SEQ ID NO: 1099): mut target(-10 +10): CCCGCCCATCTGGGTAGGAGA (SEQ ID NO: 1100): [Model Cell line information]: cell: NCIH1573: cancer type: LUNG: PAM dist: 7: indel length: 0: CRISPR gRNA ID: GF-CCELg9-56: [crRNA sequence]: crRNA sequence: AAACAGTCTCCTACCCAGATGGG (SEQ ID NO: 1111):
SpgRNA: attctaatacgactcactataggAAACAGTCTCCTACCCAGATgttttagagctagaaatagcaagttaaaataaggctagtccgtt atcaacttgaaaaagtggcaccgagtcggtgc (SEQ ID NO: 1112): [Target gene information]: Gene ID: 171023: Symbol: ASXL1: Ensembl Transcript ID: EN5T00000375687.4: GRCh: 37: Chr: 20: [Target cancer mutation information]: mut start: 31021718: mut end: 31021718: mut class: Missense Mutation: mut type: SNP: ref seq: C: mut seq: T: mut aa: p.R573W: mutation info source: CCLE: ref target(-10 +10): CCCGCCCATCCGGGTAGGAGA (SEQ ID NO: 1099): mut target(-10 +10): CCCGCCCATCTGGGTAGGAGA (SEQ ID NO: 1100): [Model Cell line information]: cell: NCIH1573: cancer type: LUNG: PAM dist: 4: indel length: 0: CRISPR gRNA ID: GF-CCELg9-57: [crRNA sequence]: crRNA sequence: AGTCTCCTACCCAGATGGGCGGG (SEQ ID NO: 1113):
SpgRNA: attctaatacgactcactataggAGTCTCCTACCCAGATGGGCgttttagagctagaaatagcaagttaaaataaggctagtccgtt atcaacttgaaaaagtggcaccgagtcggtgc (SEQ ID NO: 1114): [Target gene information]: Gene ID: 171023: Symbol: ASXL1: Ensembl Transcript ID: EN5T00000375687.4: GRCh: 37: Chr: 20: [Target cancer mutation information]: mut start: 31021718: mut end: 31021718: mut class: Missense Mutation: mut type: SNP: ref seq: C: mut seq: T: mut aa: p.R573W: mutation info source: CCLE: ref target(-10 +10): CCCGCCCATCCGGGTAGGAGA (SEQ ID NO: 1099): mut target(-10 +10): CCCGCCCATCTGGGTAGGAGA (SEQ ID NO: 1100): [Model Cell line information]: cell: NCIH1573: cancer type: LUNG: PAM dist: 8: indel length: 0: CRISPR gRNA ID: GF-CCELg9-58: [crRNA sequence]: crRNA sequence: ACCCAGATGGGCGGGACTTTGGG (SEQ ID NO: 1115):
SpgRNA: attctaatacgactcactataggACCCAGATGGGCGGGACTTTgttttagagctagaaatagcaagttaaaataaggctagtccgtt atcaacttgaaaaagtggcaccgagtcggtgc (SEQ ID NO: 1116): [Target gene information]: Gene ID: 171023: Symbol: ASXL1: Ensembl Transcript ID: EN5T00000375687.4: GRCh: 37: Chr: 20: [Target cancer mutation TABLE 7-continued Illustrative guide RNA sequences for polypeptides comprising Cas9 information]: mut start: 31021718: mut end: 31021718: mut class: Missense Mutation: mut type: SNP: ref seq: C: mut seq: T: mut aa: p.R573W: mutation info source: CCLE: ref target(-10 +10):
CCCGCCCATCCGGGTAGGAGA (SEQ ID NO: 1099): mut target(-10 +10):
CCCGCCCATCTGGGTAGGAGA (SEQ ID NO: 1100): [Model Cell line information]: cell: NCIH1573:
cancer type: LUNG: PAM dist: 16: indel length: 0: CRISPR gRNA ID: GF-CCELg9-59: [crRNA sequence]:
crRNA sequence: AAAGTCCCGCCCATTTGGGTAGG (SEQ ID NO: 1117):
SpgRNA: attctaatacgactcactataggAAAGTCCCGCCCATTTGGGTagagctagaaatagcaagttaaaataaggctagtccgtt
atcaacttgaaaaagtggcaccgagtcggtgc (SEQ ID NO: 1118): [Target gene information]: Gene ID: 171023:
Symbol: ASXL1: Ensembl Transcript ID: EN5T00000375687.4: GRCh: 37: Chr: 20: [Target cancer mutation
information]: mut start: 31021717: mut end: 31021718: mut class: Missense Mutation: mut type: DNP: ref
seq: CC: mut seq: TT: mut aa: p.R573W: mutation info source: CCLE: ref target(-10 +10):
TCCCGCCCATCCCGGGTAGGAGA (SEQ ID NO: 142): mut target(-10 +10):
TCCCGCCCATTTGGGTAGGAGA (SEQ ID NO: 143): [Model Cell line information]: cell: NCIH1573:
cancer type: LUNG: PAM dist: 5: indel length: 0: CRISPR gRNA ID: GF-CCELg9-60: [crRNA sequence]:
crRNA sequence: AGCCCAAAGTCCCGCCCATTTGG (SEQ ID NO: 1119):
SpgRNA: attctaatacgactcactataggAGCCCAAAGTCCCGCCCATTgttttagagctagaaatagcaagttaaaataaggctagtccgtt
atcaacttgaaaaagtggcaccgagtcggtgc (SEQ ID NO: 1082): [Target gene information]: Gene ID: 171023:
Symbol: ASXL1: Ensembl Transcript ID: EN5T00000375687.4: GRCh: 37: Chr: 20: [Target cancer mutation
information]: mut start: 31021717: mut end: 31021718: mut class: Missense Mutation: mut type: DNP: ref
seq: CC: mut seq: TT: mut aa: p.R573W: mutation info source: CCLE: ref target(-10 +10):
TCCCGCCCATCCCGGGTAGGAGA (SEQ ID NO: 142): mut target(-10 +10):
TCCCGCCCATTTGGGTAGGAGA (SEQ ID NO: 143): [Model Cell line information]: cell: NCIH1573:
cancer type: LUNG: PAM dist: 0: indel length: 0: CRISPR gRNA ID: GF-CCELg9-61: [crRNA sequence]:
crRNA sequence: GCCCAAAGTCCCGCCCATTTGGG (SEQ ID NO: 1120):
SpgRNA: attctaatacgactcactataggGCCCAAAGTCCCGCCCATTTgttttagagctagaaatagcaagttaaaataaggctagtccgtt
atcaacttgaaaaagtggcaccgagtcggtgc (SEQ ID NO: 1121): [Target gene information]: Gene ID: 171023:
Symbol: ASXL1: Ensembl Transcript ID: EN5T00000375687.4: GRCh: 37: Chr: 20: [Target cancer mutation
information]: mut start: 31021717: mut end: 31021718: mut class: Missense Mutation: mut type: DNP: ref
seq: CC: mut seq: TT: mut aa: p.R573W: mutation info source: CCLE: ref target(-10 +10):
TCCCGCCCATCCCGGGTAGGAGA (SEQ ID NO: 142): mut target(-10 +10):
TCCCGCCCATTTGGGTAGGAGA (SEQ ID NO: 143): [Model Cell line information]: cell: NCIH1573:
cancer type: LUNG: PAM dist: 1: indel length: 0: CRISPR gRNA ID: GF-CCELg9-62: [crRNA sequence]:
crRNA sequence: CAAACAGTCTCCTACCCAAATGG (SEQ ID NO: 1122):
SpgRNA: attctaatacgactcactataggCAAACAGTCTCCTACCCAAAgttttagagctagaaatagcaagttaaaataaggctagtccgtt
atcaacttgaaaaagtggcaccgagtcggtgc (SEQ ID NO: 1123): [Target gene information]: Gene ID: 171023:
Symbol: ASXL1: Ensembl Transcript ID: EN5T00000375687.4: GRCh: 37: Chr: 20: [Target cancer mutation
information]: mut start: 31021717: mut end: 31021718: mut class: Missense Mutation: mut type: DNP: ref
seq: CC: mut seq: TT: mut aa: p.R573W: mutation info source: CCLE: ref target(-10 +10):
TCCCGCCCATCCCGGGTAGGAGA (SEQ ID NO: 142): mut target(-10 +10):
TCCCGCCCATTTGGGTAGGAGA (SEQ ID NO: 143): [Model Cell line information]: cell: NCIH1573:
cancer type: LUNG: PAM dist: 2: indel length: 0: CRISPR gRNA ID: GF-CCELg9-63: [crRNA sequence]:
crRNA sequence: TACCCAAATGGGCGGGACTTTGG (SEQ ID NO: 1124):
SpgRNA: attctaatacgactcactataggTACCCAAATGGGCGGGACTTgttttagagctagaaatagcaagttaaaataaggctagtccgtt
atcaacttgaaaaagtggcaccgagtcggtgc (SEQ ID NO: 1125): [Target gene information]: Gene ID: 171023:
Symbol: ASXL1: Ensembl Transcript ID: ENST00000375687.4: GRCh: 37: Chr: 20: [Target cancer mutation
information]: mut start: 31021717: mut end: 31021718: mut class: Missense Mutation: mut type: DNP: ref
seq: CC: mut seq: TT: mut aa: p.R573W: mutation info source: CCLE: ref target(-10 +10):
TCCCGCCCATCCCGGGTAGGAGA (SEQ ID NO: 142): mut target(-10 +10):
TCCCGCCCATTTGGGTAGGAGA (SEQ ID NO: 143): [Model Cell line information]: cell: NCIH1573:
cancer type: LUNG: PAM dist: 14: indel length: 0: CRISPR gRNA ID: GF-CCELg9-64: [crRNA sequence]:
crRNA sequence: CAGTCTCCTACCCAAATGGGCGG (SEQ ID NO: 1126):
SpgRNA: attctaatacgactcactataggCAGTCTCCTACCCAAATGGGCGgttttagagctagaaatagcaagttaaaataaggctagtccgtt
atcaacttgaaaaagtggcaccgagtcggtgc (SEQ ID NO: 1127): [Target gene information]: Gene ID: 171023:
Symbol: ASXL1: Ensembl Transcript ID: EN5T00000375687.4: GRCh: 37: Chr: 20: [Target cancer mutation
information]: mut start: 31021717: mut end: 31021718: mut class: Missense Mutation: mut type: DNP: ref
seq: CC: mut seq: TT: mut aa: p.R573W: mutation info source: CCLE: ref target(-10 +10):
TCCCGCCCATCCCGGGTAGGAGA (SEQ ID NO: 142): mut target(-10 +10):
TCCCGCCCATTTGGGTAGGAGA (SEQ ID NO: 143): [Model Cell line information]: cell: NCIH1573:
cancer type: LUNG: PAM dist: 6: indel length: 0: CRISPR gRNA ID: GF-CCELg9-65: [crRNA sequence]:
crRNA sequence: AAACAGTCTCCTACCCAAATGGG (SEQ ID NO: 1128):
SpgRNA: attctaatacgactcactataggAAACAGTCTCCTACCCAAATgttttagagctagaaatagcaagttaaaataaggctagtccgtt
atcaacttgaaaaagtggcaccgagtcggtgc (SEQ ID NO: 1129): [Target gene information]: Gene ID: 171023:
Symbol: ASXL1: Ensembl Transcript ID: EN5T00000375687.4: GRCh: 37: Chr: 20: [Target cancer mutation
information]: mut start: 31021717: mut end: 31021718: mut class: Missense Mutation: mut type: DNP: ref
seq: CC: mut seq: TT: mut aa: p.R573W: mutation info source: CCLE: ref target(-10 +10):
TCCCGCCCATCCCGGGTAGGAGA (SEQ ID NO: 142): mut target(-10 +10):
TCCCGCCCATTTGGGTAGGAGA (SEQ ID NO: 143): [Model Cell line information]: cell: NCIH1573:
cancer type: LUNG: PAM dist: 3: indel length: 0: CRISPR gRNA ID: GF-CCELg9-66: [crRNA sequence]:
crRNA sequence: AGTCTCCTACCCAAATGGGCGGG (SEQ ID NO: 1130):
SpgRNA: attctaatacgactcactataggAGTCTCCTACCCAAATGGGCGgttttagagctagaaatagcaagttaaaataaggctagtccgtt
atcaacttgaaaaagtggcaccgagtcggtgc (SEQ ID NO: 1131): [Target gene information]: Gene ID: 171023:
Symbol: ASXL1: Ensembl Transcript ID: EN5T00000375687.4: GRCh: 37: Chr: 20: [Target cancer mutation
information]: mut start: 31021717: mut end: 31021718: mut class: Missense Mutation: mut type: DNP: ref
seq: CC: mut seq: TT: mut aa: p.R573W: mutation info source: CCLE: ref target(-10 +10):
TCCCGCCCATCCCGGGTAGGAGA (SEQ ID NO: 142): mut target(-10 +10):
TCCCGCCCATTTGGGTAGGAGA (SEQ ID NO: 143): [Model Cell line information]: cell: NCIH1573:
cancer type: LUNG: PAM dist: 7: indel length: 0: CRISPR gRNA ID: GF-CCELg9-67: [crRNA sequence]:
crRNA sequence: ACCCAAATGGGCGGGACTTTGGG (SEQ ID NO: 1132):

TABLE 7-continued

Illustrative guide RNA sequences for polypeptides comprising Cas9

SpgRNA: attctaatacgactcactataggACCCAAATGGGCGGGACTTTgttttagagctagaaatagcaagttaaaataaggctagtccgtt
atcaacttgaaaaagtggcaccgagtcggtgc (SEQ ID NO: 1133): [Target gene information]: Gene ID: 171023:
Symbol: ASXL1: Ensembl Transcript ID: EN5T00000375687.4: GRCh: 37: Chr: 20: [Target cancer mutation
information]: mut start: 31021717: mut end: 31021718: mut class: Missense Mutation: mut type: DNP: ref
seq: CC: mut seq: TT: mut aa: p.R573W: mutation info source: CCLE: ref target(-10 +10):
TCCCGCCCATCCGGGTAGGAGA (SEQ ID NO: 142): mut target(-10 +10):
TCCCGCCCATTTGGGTAGGAGA (SEQ ID NO: 143): [Model Cell line information]: cell: NCIH1573:
cancer type: LUNG: PAM dist: 15: indel length: 0: CRISPR gRNA ID: GF-CCELg9-68: [crRNA sequence]:
crRNA sequence: TAAAGCAGCTGAGTCACTAAAGG (SEQ ID NO: 1134):
SpgRNA: attctaatacgactcactataggTAAAGCAGCTGAGTCACTAAgttttagagctagaaatagcaagttaaaataaggctagtccgtt
atcaacttgaaaaagtggcaccgagtcggtgc (SEQ ID NO: 1135): [Target gene information]: Gene ID: 55252:
Symbol: ASXL2: Ensembl Transcript ID: EN5T00000435504.4: GRCh: 37: Chr: 2: [Target cancer mutation
information]: mut start: 25966334: mut end: 25 966334: mut class: Nonsense Mutation: mut type: SNP: ref
seq: G: mut seq: A: mut aa: p.Q958*: mutation info source: CCLE: ref target(-10 +10):
TCTTTGCCTTGAAGCAGCTGA (SEQ ID NO: 146): mut target(-10 +10):
TCTTTGCCTTAAAGCAGCTGA (SEQ ID NO: 147): [Model Cell line information]: cell: HCC827GR5:
cancer type: LUNG: PAM dist: 19: indel length: 0: CRISPR gRNA ID: GF-CCELg9-69: [crRNA sequence]:
crRNA sequence: TTAGTGACTCAGCTGCTTTAAGG (SEQ ID NO: 1136):
SpgRNA: attctaatacgactcactataggTTAGTGACTCAGCTGCTTTAAGgttttagagctagaaatagcaagttaaaataaggctagtccgtta
tcaacttgaaaaagtggcaccgagtcggtgc (SEQ ID NO: 113 7): [Target gene information]: Gene ID: 55252: Symbol:
ASXL2: Ensembl Transcript ID: EN5T00000435504.4: GRCh: 37: Chr: 2: [Target cancer mutation
information]: mut start: 25966334: mut end: 25966334: mut class: Nonsense Mutation: mut type: SNP: ref
seq: G: mut seq: A: mut aa: p.Q958*: mutation info source: CCLE: ref target(-10 +10):
TCTTTGCCTTGAAGCAGCTGA (SEQ ID NO: 146): mut target(-10 +10):
TCTTTGCCTTAAAGCAGCTGA (SEQ ID NO: 147): [Model Cell line information]: cell: HCC827GR5:
cancer type: LUNG: PAM dist: 2: indel length: 0: CRISPR gRNA ID: GF-CCELg9-70: [crRNA sequence]:
crRNA sequence: TTAAGGCAAAGATGTTCCCATGG (SEQ ID NO: 1138):
SpgRNA: attctaatacgactcactataggTTAAGGCAAAGATGTTCCCAgttttagagctagaaatagcaagttaaaataaggctagtccgtt
atcaacttgaaaaagtggcaccgagtcggtgc (SEQ ID NO: 1139): [Target gene information]: Gene ID: 55252:
Symbol: ASXL2: Ensembl Transcript ID: EN5T00000435504.4: GRCh: 37: Chr: 2: [Target cancer mutation
information]: mut start: 25966334: mut end: 25966334: mut class: Nonsense Mutation: mut type: SNP: ref
seq: G: mut seq: A: mut aa: p.Q958*: mutation info source: CCLE: ref target(-10 +10):
TCTTTGCCTTGAAGCAGCTGA (SEQ ID NO: 146): mut target(-10 +10):
TCTTTGCCTTAAAGCAGCTGA (SEQ ID NO: 147): [Model Cell line information]: cell: HCC827GR5:
cancer type: LUNG: PAM dist: 19: indel length: 0: CRISPR gRNA ID: GF-CCELg9-71: [crRNA sequence]:
crRNA sequence: TTCTTTCTGTGAGAAAGTACTGG (SEQ ID NO: 1140):
SpgRNA: attctaatacgactcactataggTTCTTTCTGTGAGAAAGTACgttttagagctagaaatagcaagttaaaataaggctagtccgtt
atcaacttgaaaaagtggcaccgagtcggtgc (SEQ ID NO: 1141): [Target gene information]: Gene ID: 472: Symbol:
ATM: Ensembl Transcript ID: EN5T00000452508.2: GRCh: 37: Chr: 11: [Target cancer mutation
information]: mut start: 108106527: mut end: 108106527: mut class: Silent: mut type: SNP: ref seq: A: mut
seq: G: mut aa: p.K154K: mutation info source: CCLE: ref target(-10 +10):
CTGTGAGAAAATACTGGTGTG (SEQ ID NO: 156): mut target(-10 +10):
CTGTGAGAAAGTACTGGTGTG (SEQ ID NO: 157): [Model Cell line information]: cell: 5W1990:
cancer type: PANCREAS: PAM dist: 4: indel length: 0: CRISPR gRNA ID: GF-CCELg9-72: [crRNA
sequence]: crRNA sequence: GTATGTTGTTTTTAATTTTAAGG (SEQ ID NO: 1142):
SpgRNA: attctaatacgactcactataggGTATGTTGTTTTTAATTTTAgttttagagctagaaatagcaagttaaaataaggctagtccgttat
caacttgaaaaagtggcaccgagtcggtgc (SEQ ID NO: 1143): [Target gene information]: Gene ID: 545: Symbol:
ATR: Ensembl Transcript ID: EN5T00000350721.4: GRCh: 37: Chr: 3: [Target cancer mutation information]:
mut start: 142272241: mut end: 142272241: mut class: Splice Site: mut type: SNP: ref seq: C: mut seq: T:
mut aa: -: mutation info source: CCLE: ref target(-10 +10): TTTTGCGGCCCTAAAATTAAA (SEQ ID NO:
188): mut target(-10 +10): TTTTGCGGCCTTAAAATTAAA (SEQ ID NO: 189): [Model Cell line
information]: cell: A549: cancer type: LUNG: PAM dist: 0: indel length: 0: CRISPR gRNA ID: GF-
CCELg9-73: [crRNA sequence]: crRNA sequence: TTTAATTTTAAGGCCGCAAAAGG (SEQ ID NO:
1144):
SpgRNA: attctaatacgactcactataggTTTAATTTTAAGGCCGCAAAg ttttagagctagaaatagcaagttaaaataaggctagtccgtt
atcaacttgaaaaagtggcaccgagtcggtgc (SEQ ID NO: 1145): [Target gene information]: Gene ID: 545: Symbol:
ATR: Ensembl Transcript ID: EN5T00000350721.4: GRCh: 37: Chr: 3: [Target cancer mutation information]:
mut start: 142272241: mut end: 142272241: mut class: Splice Site: mut type: SNP: ref seq: C: mut seq: T:
mut aa: -: mutation info source: CCLE: ref target(-10 +10): TTTTGCGGCCCTAAAATTAAA (SEQ ID NO:
188): mut target(-10 +10): TTTTGCGGCCTTAAAATTAAA (SEQ ID NO: 189): [Model Cell line
information]: cell: A549: cancer type: LUNG: PAM dist: 10: indel length: 0: CRISPR gRNA ID: GF-
CCELg9-74: [crRNA sequence]: crRNA sequence: TAAGGCCGCAAAAGGAGATTTGG (SEQ ID NO:
1146):
SpgRNA: attctaatacgactcactataggTAAGGCCGCAAAAGGAGATTgttttagagctagaaatagcaagttaaaataaggctagtccgt
tatcaacttgaaaaagtggcaccgagtcggtgc (SEQ ID NO: 1147): [Target gene information]: Gene ID: 545: Symbol:
ATR: Ensembl Transcript ID: ENST00000350721.4: GRCh: 37: Chr: 3: [Target cancer mutation information]:
mut start: 142272241: mut end: 142272241: mut class: Splice Site: mut type: SNP: ref seq: C: mut seq: T:
mut aa: -: mutation info source: CCLE: ref target(-10 +10): TTTTGCGGCCCTAAAATTAAA (SEQ ID NO:
188): mut target(-10 +10): TTTTGCGGCCTTAAAATTAAA (SEQ ID NO: 189): [Model Cell line
information]: cell: A549: cancer type: LUNG: PAM dist: 18: indel length: 0: CRISPR gRNA ID: GF-
CCELg9-75: [crRNA sequence]: crRNA sequence: GCCTGGGCAGGAAAAATTCTCGG (SEQ ID NO:
1148):
SpgRNA: attctaatacgactcactataggGCCTGGGCAGGAAAAATTCTgttttagagctagaaatagcaagttaaaataaggctagtccgtt
atcaacttgaaaaagtggcaccgagtcggtgc (SEQ ID NO: 1149): [Target gene information]: Gene ID: 545: Symbol:
ATR: Ensembl Transcript ID: EN5T00000350721.4: GRCh: 37: Chr: 3: [Target cancer mutation information]:
mut start: 142178136: mut end: 142178136: mut class: Missense Mutation: mut type: SNP: ref seq: G: mut
seq: A: mut aa: p.L2428F: mutation info source: CCLE: ref target(-10 +10):
CTGGGCAGGAGAAATTCTCGG (SEQ ID NO: 204): mut target(-10 +10):

TABLE 7-continued

Illustrative guide RNA sequences for polypeptides comprising Cas9

CTGGGCAGGAAAAATTCTCGG (SEQ ID NO: 205): [Model Cell line information]: cell: NCIH661:
cancer type: LUNG: PAM dist: 8: indel length: 0: CRISPR gRNA ID: GF-CCELg9-76: [crRNA sequence]:
crRNA sequence: TCCGAGAATTTTTCCTGCCCAGG (SEQ ID NO: 1150):
SpgRNA: attctaatacgactcactataggTCCGAGAATTTTTCCTGCCCgttttagagctagaaatagcaagttaaaataaggctagtccgtta
tcaacttgaaaaagtggcaccgagtcggtgc (SEQ ID NO: 1151): [Target gene information]: Gene ID: 545: Symbol:
ATR: Ensembl Transcript ID: EN5T00000350721.4: GRCh: 37: Chr: 3: [Target cancer mutation information]:
mut start: 142178136: mut end: 142178136: mut class: Missense Mutation: mut type: SNP: ref seq: G: mut
seq: A: mut aa: p.L2428F: mutation info source: CCLE: ref target(-10 +10):
CTGGGCAGGAGAAATTCTCGG (SEQ ID NO: 204): mut target(-10 +10):
CTGGGCAGGAAAAATTCTCGG (SEQ ID NO: 205): [Model Cell line information]: cell: NCIH661:
cancer type: LUNG: PAM dist: 9: indel length: 0: CRISPR gRNA ID: GF-CCELg9-77: [crRNA sequence]:
crRNA sequence: CTAGTAGCATACCTCGACCATGG (SEQ ID NO: 1152):
SpgRNA: attctaatacgactcactataggCTAGTAGCATACCTCGACCGttttagagctagaaatagcaagttaaaataaggctagtccgtt
atcaacttgaaaaagtggcaccgagtcggtgc (SEQ ID NO: 1153): [Target gene information]: Gene ID: 545: Symbol:
ATR: Ensembl Transcript ID: EN5T00000350721.4: GRCh: 37: Chr: 3: [Target cancer mutation information]:
mut start: 142212047: mut end: 142212047: mut class: Missense Mutation: mut type: SNP: ref seq: G: mut
seq: C: mut aa: p.A2002G: mutation info source: CCLE: ref target(-10 +10):
TAGTAGCATAGCTCGACCATG (SEQ ID NO: 1154): mut target(-10 +10):
TAGTAGCATACCTCGACCATG (SEQ ID NO: 1155): [Model Cell line information]: cell: NCIH2126:
cancer type: LUNG: PAM dist: 9: indel length: 0: CRISPR gRNA ID: GF-CCELg9-78: [crRNA sequence]:
crRNA sequence: TGGTCGAGGTATGCTACTAGTGG (SEQ ID NO: 1156):
SpgRNA: attctaatacgactcactataggTGGTCGAGGTATGCTACTAGgttttagagctagaaatagcaagttaaaataaggctagtccgtt
atcaacttgaaaaagtggcaccgagtcggtgc (SEQ ID NO: 1157): [Target gene information]: Gene ID: 545: Symbol:
ATR: Ensembl Transcript ID: ENST00000350721.4: GRCh: 37: Chr: 3: [Target cancer mutation information]:
mut start: 142212047: mut end: 142212047: mut class: Missense Mutation: mut type: SNP: ref seq: G: mut
seq: C: mut aa: p.A2002G: mutation info source: CCLE: ref target(-10 +10):
TAGTAGCATAGCTCGACCATG (SEQ ID NO: 1154): mut target(-10 +10):
TAGTAGCATACCTCGACCATG (SEQ ID NO: 1155): [Model Cell line information]: cell: NCIH2126:
cancer type: LUNG: PAM dist: 12: indel length: 0: CRISPR gRNA ID: GF-CCELg9-79: [crRNA sequence]:
crRNA sequence: GGTCGAGGTATGCTACTAGTGGG (SEQ ID NO: 1158):
SpgRNA: attctaatacgactcactataggGGTCGAGGTATGCTACTAGTgttttagagctagaaatagcaagttaaaataaggctagtccgtt
atcaacttgaaaaagtggcaccgagtcggtgc (SEQ ID NO: 1159): [Target gene information]: Gene ID: 545: Symbol:
ATR: Ensembl Transcript ID: EN5T00000350721.4: GRCh: 37: Chr: 3: [Target cancer mutation information]:
mut start: 142212047: mut end: 142212047: mut class: Missense Mutation: mut type: SNP: ref seq: G: mut
seq: C: mut aa: p.A2002G: mutation info source: CCLE: ref target(-10 +10):
TAGTAGCATAGCTCGACCATG (SEQ ID NO: 1154): mut target(-10 +10):
TAGTAGCATACCTCGACCATG (SEQ ID NO: 1155): [Model Cell line information]: cell: NCIH2126:
cancer type: LUNG: PAM dist: 13: indel length: 0: CRISPR gRNA ID: GF-CCELg9-80: [crRNA sequence]:
crRNA sequence: CTTTCCAATTGCACTGACTCCGG (SEQ ID NO: 1160):
SpgRNA: attctaatacgactcactataggCTTTCCAATTGCACTGACTCgttttagagctagaaatagcaagttaaaataaggctagtccgtta
tcaacttgaaaaagtggcaccgagtcggtgc (SEQ ID NO: 1161): [Target gene information]: Gene ID: 545: Symbol:
ATR: Ensembl Transcript ID: EN5T00000350721.4: GRCh: 37: Chr: 3: [Target cancer mutation information]:
mut start: 142224091: mut end: 142224091: mut class: Missense Mutation: mut type: SNP: ref seq: T: mut
seq: C: mut aa: p.R1696G: mutation info source: CCLE: ref target(-10 +10):
TCTGCCTTTCTAATTGCACTG (SEQ ID NO: 2 1 2): mut target(-10 +10):
TCTGCCTTTCCAATTGCACTG (SEQ ID NO: 213): [Model Cell line information]: cell: NCIH661:
cancer type: LUNG: PAM dist: 15: indel length: 0: CRISPR gRNA ID: GF-CCELg9-81: [crRNA sequence]:
crRNA sequence: CGGAGTCAGTGCAATTGGAAAGG (SEQ ID NO: 1162):
SpgRNA: attctaatacgactcactataggCGGAGTCAGTGCAATTGGAAgttttagagctagaaatagcaagttaaaataaggctagtccgt
tatcaacttgaaaaagtggcaccgagtcggtgc (SEQ ID NO: 1163): [Target gene information]: Gene ID: 545: Symbol:
ATR: Ensembl Transcript ID: ENST00000350721.4: GRCh: 37: Chr: 3: [Target cancer mutation information]:
mut start: 142224091: mut end: 142224091: mut class: Missense Mutation: mut type: SNP: ref seq: T: mut
seq: C: mut aa: p.R1696G: mutation info source: CCLE: ref target(-10 +10):
TCTGCCTTTCTAATTGCACTG (SEQ ID NO: 212): mut target(-10 +10):
TCTGCCTTTCCAATTGCACTG (SEQ ID NO: 213): [Model Cell line information]: cell: NCIH661:
cancer type: LUNG: PAM dist: 4: indel length: 0: CRISPR gRNA ID: GF-CCELg9-82: [crRNA sequence]:
crRNA sequence: GTGGCCGGAGTCAGTGCAATTGG (SEQ ID NO: 1164):
SpgRNA: attctaatacgactcactataggGTGGCCGGAGTCAGTGCAATgttttagagctagaaatagcaagttaaaataaggctagtccgtt
atcaacttgaaaaagtggcaccgagtcggtgc (SEQ ID NO: 1165): [Target gene information]: Gene ID: 545: Symbol:
ATR: Ensembl Transcript ID: ENST00000350721.4: GRCh: 37: Chr: 3: [Target cancer mutation information]:
mut start: 142224091: mut end: 142224091: mut class: Missense Mutation: mut type: SNP: ref seq: T: mut
seq: C: mut aa: p.R1696G: mutation info source: CCLE: ref target(-10 +10):
TCTGCCTTTCTAATTGCACTG (SEQ ID NO: 212): mut target(-10 +10):
TCTGCCTTTCCAATTGCACTG (SEQ ID NO: 213): [Model Cell line information]: cell: NCIH661:
cancer type: LUNG: PAM dist: -1: indel length: 0: CRISPR gRNA ID: GF-CCELg9-83: [crRNA sequence]:
crRNA sequence: CTACTTAACATCTGAAAATCTGG (SEQ ID NO: 1166):
SpgRNA: attctaatacgactcactataggCTACTTAACATCTGAAAATCgttttagagctagaaatagcaagttaaaataaggctagtccgtt
atcaacttgaaaaagtggcaccgagtcggtgc (SEQ ID NO: 1167): [Target gene information]: Gene ID: 546: Symbol:
ATRX: Ensembl Transcript ID: EN5T00000373344.5: GRCh: 37: Chr: X: [Target cancer mutation
information]: mut start: 76855979: mut end: 76855979: mut class: Missense Mutation: mut type: SNP: ref
seq: T: mut seq: G: mut aa: p.Q1874P: mutation info source: CCLE: ref target(-10 +10):
CTGAAAATCTTGGAAAAGCTT (SEQ ID NO: 220): mut target(-10 +10):
CTGAAAATCTGGGAAAAGCTT (SEQ ID NO: 221): [Model Cell line information]: cell: NCIH661:
cancer type: LUNG: PAM dist: -1: indel length: 0: CRISPR gRNA ID: GF-CCELg9-84: [crRNA sequence]:
crRNA sequence: TACTTAACATCTGAAAATCGGGG (SEQ ID NO: 1168):
SpgRNA: attctaatacgactcactataggTACTTAACATCTGAAAATCTgttttagagctagaaatagcaagttaaaataaggctagtccgtt
atcaacttgaaaaagtggcaccgagtcggtgc (SEQ ID NO: 1169): [Target gene information]: Gene ID: 546: Symbol:
ATRX: Ensembl Transcript ID: EN5T00000373344.5: GRCh: 37: Chr: X: [Target cancer mutation TABLE 7-continued Illustrative guide RNA sequences for polypeptides comprising Cas9 information]: mut start: 76855979: mut end: 76855979: mut class: Missense Mutation: mut type: SNP: ref
seq: T: mut seq: G: mut aa: p.Q1874P: mutation info source: CCLE: ref target(-10 +10):
CTGAAAATCTTGGAAAAGCTT (SEQ ID NO: 220): mut target(-10 +10):
CTGAAAATCTGGGAAAAGCTT (SEQ ID NO: 221): [Model Cell line information]: cell: NCIH661:
cancer type: LUNG: PAM dist: 0: indel length: 0: CRISPR gRNA ID: GF-CCELg9-85: [crRNA sequence]:
crRNA sequence: GAAAAAAATAGTAGCTCAAGTGG (SEQ ID NO: 1170):
SpgRNA: attctaatacgactcactataggGAAAAAAATAGTAGCTCAAGgilftagagctagaaatagcaagttaaaataaggctagtccgt
tatcaacttgaaaaagtggcaccgagtcggtgc (SEQ ID NO: 1171): [Target gene information]: Gene ID: 546: Symbol:
ATRX: Ensembl Transcript ID: ENST00000373344.5: GRCh: 37: Chr: X: [Target cancer mutation
informa-
tion]: mut start: 76855018: mut end: 76855019: mut class: Frame Shift Ins: mut type: INS: ref seq: -:
mut seq: T: mut aa: p.D1940fs: mutation info source: CCLE: ref target(-10 +10): GAGCTACTAT
TTTTTCCCCT (SEQ ID NO: 230): mut target(-10 +10): GAGCTACTATTTTTTTCCCCT (SEQ ID NO:
23 1): [Model Cell line information]: cell: NCIH661: cancer type: LUNG: PAM dist: 14: indel length: 1:
CRISPR gRNA ID: GF-CCELg9-86: [crRNA sequence]: crRNA sequence:
AATAGTAGCTCAAGTGGAAGTGG (SEQ ID NO: 1172):
SpgRNA: attctaatacgactcactataggAATAGTAGCTCAAGTGGAAGgilftagagctagaaatagcaagttaaaataaggctagtccgt
tatcaacttgaaaaagtggcaccgagtcggtgc (SEQ ID NO: 1173): [Target gene information]: Gene ID: 546: Symbol:
ATRX: Ensembl Transcript ID: EN5T00000373344.5: GRCh: 37: Chr: X: [Target cancer mutation
informa-
tion]: mut start: 76855018: mut end: 76855019: mut class: Frame Shift Ins: mut type: INS: ref seq: -:
mut seq: T: mut aa: p.D1940fs: mutation info source: CCLE: ref target(-10 +10): GAGCTACTAT
TTTTTCCCCT (SEQ ID NO: 230): mut target(-10 +10): GAGCTACTATTTTTTTCCCCT (SEQ ID NO:
23 1): [Model Cell line information]: cell: NCIH661: cancer type: LUNG: PAM dist: 20: indel length: 1:
CRISPR gRNA ID: GF-CCELg9-87: [crRNA sequence]: crRNA sequence:
TCCTACCTGCTTTGCCGGCCAGG (SEQ ID NO: 1174):
SpgRNA: attctaatacgactcactataggTCCTACCTGCTTTGCCGGCCgliftagagctagaaatagcaagttaaaataaggctagtccgtta
tcaacttgaaaaagtggcaccgagtcggtgc (SEQ ID NO: 1175): [Target gene information]: Gene ID: 54880: Symbol:
BCOR: Ensembl Transcript ID: EN5T00000378444.4: GRCh: 37: Chr: X: [Target cancer mutation
information]: mut start: 39923005: mut end: 39923005: mut class: Nonsense Mutation: mut type: SNP: ref
seq: T: mut seq: A: mut aa: p.K1235*: mutation info source: CCLE: ref target(-10 +10):
GTCACTTCCTTCCTGCTTTGC (SEQ ID NO: 1176): mut target(-10 +10):
GTCACTTCCTACCTGCTTTGC (SEQ ID NO: 1177): [Model Cell line information]: cell: NCIH1563:
cancer type: LUNG: PAM dist: 16: indel length: 0: CRISPR gRNA ID: GF-CCELg9-88: [crRNA sequence]:
crRNA sequence: TCACTTCCTACCTGCTTTGCCGG (SEQ ID NO: 1178):
SpgRNA: attctaatacgactcactataggTCACTTCCTACCTGCTTTGCgliftagagctagaaatagcaagttaaaataaggctagtccgtta
tcaacttgaaaaagtggcaccgagtcggtgc (SEQ ID NO: 1179): [Target gene information]: Gene ID: 54880: Symbol:
BCOR: Ensembl Transcript ID: EN5T00000378444.4: GRCh: 37: Chr: X: [Target cancer mutation
information]: mut start: 39923005: mut end: 39923005: mut class: Nonsense Mutation: mut type: SNP: ref
seq: T: mut seq: A: mut aa: p.K1235*: mutation info source: CCLE: ref target(-10 +10):
GTCACTTCCTTCCTGCTTTGC (SEQ ID NO: 1176): mut target(-10 +10):
GTCACTTCCTACCTGCTTTGC (SEQ ID NO: 1177): [Model Cell line information]: cell: NCIH1563:
cancer type: LUNG: PAM dist: 11: indel length: 0: CRISPR gRNA ID: GF-CCELg9-89: [crRNA sequence]:
crRNA sequence: ACCTGGCCGGCAAAGCAGGTAGG (SEQ ID NO: 1180):
SpgRNA: attctaatacgactcactataggACCTGGCCGGCAAAGCAGGTgttttagagctagaaatagcaagttaaaataaggctagtccgt
tatcaacttgaaaaagtggcaccgagtcggtgc (SEQ ID NO: 1181): [Target gene information]: Gene ID: 54880:
Symbol: BCOR: Ensembl Transcript ID: EN5T00000378444.4: GRCh: 37: Chr: X: [Target cancer mutation
information]: mut start: 39923005: mut end: 39923005: mut class: Nonsense Mutation: mut type: SNP: ref
seq: T: mut seq: A: mut aa: p.K1235*: mutation info source: CCLE: ref target(-10 +10):
GTCACTTCCTTCCTGCTTTGC (SEQ ID NO: 1176): mut target(-10 +10):
GTCACTTCCTACCTGCTTTGC (SEQ ID NO: 1177): [Model Cell line information]: cell: NCIH1563:
cancer type: LUNG: PAM dist: 1: indel length: 0: CRISPR gRNA ID: GF-CCELg9-90: [crRNA sequence]:
crRNA sequence: AAGCAGGTAGGAAGTGACCCAGG (SEQ ID NO: 1182):
SpgRNA: attctaatacgactcactataggAAGCAGGTAGGAAGTGACCCgttttagagctagaaatagcaagttaaaataaggctagtccgt
tatcaacttgaaaaagtggcaccgagtcggtgc (SEQ ID NO: 1183): [Target gene information]: Gene ID: 54880:
Symbol: BCOR: Ensembl Transcript ID: EN5T00000378444.4: GRCh: 37: Chr: X: [Target cancer mutation
information]: mut start: 39923005: mut end: 39923005: mut class: Nonsense Mutation: mut type: SNP: ref
seq: T: mut seq: A: mut aa: p.K1235*: mutation info source: CCLE: ref target(-10 +10):
GTCACTTCCTTCCTGCTTTGC (SEQ ID NO: 1176): mut target(-10 +10):
GTCACTTCCTACCTGCTTTGC (SEQ ID NO: 1177): [Model Cell line information]: cell: NCIH1563:
cancer type: LUNG: PAM dist: 13: indel length: 0: CRISPR gRNA ID: GF-CCELg9-91: [crRNA sequence]:
crRNA sequence: AGACAGGATTGTCTGCCACCAGG (SEQ ID NO: 1184):
SpgRNA: attctaatacgactcactataggAGACAGGATTGTCTGCCACCgttttagagctagaaatagcaagttaaaataaggctagtccgtt
atcaacttgaaaaagtggcaccgagtcggtgc (SEQ ID NO: 1185): [Target gene information]: Gene ID: 641: Symbol:
BLM: Ensembl Transcript ID: EN5T00000355112.3: GRCh: 37: Chr: 15: [Target cancer mutation
information]: mut start: 91304040: mut end: 91304040: mut class: Missense Mutation: mut type: SNP: ref
seq: C: mut seq: G: mut aa: p.F479L: mutation info source: CCLE: ref target(-10 +10):
AGACAGGATTCTCTGCCACCA (SEQ ID NO: 1186): mut target(-10 +10):
AGACAGGATTGTCTGCCACCA (SEQ ID NO: 1187): [Model Cell line information]: cell: NCIH1573:
cancer type: LUNG: PAM dist: 10: indel length: 0: CRISPR gRNA ID: GF-CCELg9-92: [crRNA sequence]:
crRNA sequence: CAGACAATCCTGTCTTTCCTAGG (SEQ ID NO: 1188):
SpgRNA: attctaatacgactcactataggCAGACAATCCTGTCTTTCCTgttttagagctagaaatagcaagttaaaataaggctagtccgtta
tcaacttgaaaaagtggcaccgagtcggtgc (SEQ ID NO: 1189): [Target gene information]: Gene ID: 641: Symbol:
BLM: Ensembl Transcript ID: ENST00000355112.3: GRCh: 37: Chr: 15: [Target cancer mutation
information]: mut start: 91304040: mut end: 91304040: mut class: Missense Mutation: mut type: SNP: ref
seq: C: mut seq: G: mut aa: p.F479L: mutation info source: CCLE: ref target(-10 +10):
AGACAGGATTCTCTGCCACCA (SEQ ID NO: 1186): mut target(-10 +10):
AGACAGGATTGTCTGCCACCA (SEQ ID NO: 1187): [Model Cell line information]: cell: NCIH1573:

TABLE 7-continued

Illustrative guide RNA sequences for polypeptides comprising Cas9 cancer type: LUNG: PAM dist: 16: indel length: 0: CRISPR gRNA ID: GF-CCELg9-93: [crRNA sequence]:
crRNA sequence: CAATCCTGTCTTTCCTAGGGTGG (SEQ ID NO: 1190):
SpgRNA: attctaatacgactcactataggCAATCCTGTCTTTCCTAGGGgttttagagctagaaatagcaagttaaaataaggctagtccgtta
tcaacttgaaaaagtggcaccgagtcggtgc (SEQ ID NO: 1191): [Target gene information]: Gene ID: 641: Symbol:
BLM: Ensembl Transcript ID: EN5T00000355112.3: GRCh: 37: Chr: 15: [Target cancer mutation
information]: mut start: 91304040: mut end: 91304040: mut class: Missense Mutation: mut type: SNP: ref
seq: C: mut seq: G: mut aa: p.F479L: mutation info source: CCLE: ref target(-10 +10):
AGACAGGATTCTCTGCCACCA (SEQ ID NO: 1186): mut target(-10 +10):
AGACAGGATTGTCTGCCACCA (SEQ ID NO: 1187): [Model Cell line information]: cell: NCIH1573:
cancer type: LUNG: PAM dist: 20: indel length: 0: CRISPR gRNA ID: GF-CCELg9-94: [crRNA sequence]:
crRNA sequence: AGACAATCCTGTCTTTCCTAGGG (SEQ ID NO: 1192):
SpgRNA: attctaatacgactcactataggAGACAATCCTGTCTTTCCTAGgttttagagctagaaatagcaagttaaaataaggctagtccgtta
tcaacttgaaaaagtggcaccgagtcggtgc (SEQ ID NO: 1193): [Target gene information]: Gene ID: 641: Symbol:
BLM: Ensembl Transcript ID: EN5T00000355112.3: GRCh: 37: Chr: 15: [Target cancer mutation
information]: mut start: 91304040: mut end: 91304040: mut class: Missense Mutation: mut type: SNP: ref
seq: C: mut seq: G: mut aa: p.F479L: mutation info source: CCLE: ref target(-10 +10):
AGACAGGATTCTCTGCCACCA (SEQ ID NO: 1186): mut target(-10 +10):
AGACAGGATTGTCTGCCACCA (SEQ ID NO: 1187): [Model Cell line information]: cell: NCIH1573:
cancer type: LUNG: PAM dist: 17: indel length: 0: CRISPR gRNA ID: GF-CCELg9-95: [crRNA sequence]:
crRNA sequence: CAGAAAAATGTGTGTATTGTTGG (SEQ ID NO: 1194):
SpgRNA: attctaatacgactcactataggCAGAAAAATGTGTGTATTGTgttttagagctagaaatagcaagttaaaataaggctagtccgtt
atcaacttgaaaaagtggcaccgagtcggtgc (SEQ ID NO: 1195): [Target gene information]: Gene ID: 672: Symbol:
BRCA1: Ensembl Transcript ID: EN5T00000357654.3: GRCh: 37: Chr: 17: [Target cancer mutation
information]: mut start: 41234421: mut end: 41234421: mut class: Splice Site: mut type: SNP: ref seq: C:
mut seq: A: mut aa: p.A14535: mutation info source: CCLE: ref target(-10 +10):
CAATACACACCTTTTTCTGAT (SEQ ID NO: 241): mut target(-10 +10):
CAATACACACATTTTTCTGAT (SEQ ID NO: 242): [Model Cell line information]: cell: NCIH1563:
cancer type: LUNG: PAM dist: 12: indel length: 0: CRISPR gRNA ID: GF-CCELg9-96: [crRNA sequence]:
crRNA sequence: GGAATACAGTTGGCTGATGTTGG (SEQ ID NO: 1196):
SpgRNA: attctaatacgactcactataggGGAATACAGTTGGCTGATGTgttttagagctagaaatagcaagttaaaataaggctagtccgtt
atcaacttgaaaaagtggcaccgagtcggtgc (SEQ ID NO: 1197): [Target gene information]: Gene ID: 675: Symbol:
BRCA2: Ensembl Transcript ID: ENST00000380152.3: GRCh: 37: Chr: 13: [Target cancer mutation
information]: mut start: 32932012: mut end: 32932012: mut class: Missense Mutation: mut type: SNP: ref
seq: G: mut seq: T: mut aa: p.G2584V: mutation info source: CCLE: ref target(-10 +10):
TTGGCTGATGGTGGATGGCTC (SEQ ID NO: 1198): mut target(-10 +10):
TTGGCTGATGTTGGATGGCTC (SEQ ID NO: 1199): [Model Cell line information]: cell: NCIH661:
cancer type: LUNG: PAM dist: 1: indel length: 0: CRISPR gRNA ID: GF-CCELg9-97: [crRNA sequence]:
crRNA sequence: TACAGTTGGCTGATGTTGGATGG (SEQ ID NO: 1200):
SpgRNA: attctaatacgactcactataggTACAGTTGGCTGATGTTGGAgttttagagctagaaatagcaagttaaaataaggctagtccgtt
atcaacttgaaaaagtggcaccgagtcggtgc (SEQ ID NO: 1201): [Target gene information]: Gene ID: 675: Symbol:
BRCA2: Ensembl Transcript ID: EN5T00000380152.3: GRCh: 37: Chr: 13: [Target cancer mutation
information]: mut start: 32932012: mut end: 32932012: mut class: Missense Mutation: mut type: SNP: ref
seq: G: mut seq: T: mut aa: p.G2584V: mutation info source: CCLE: ref target(-10 +10):
TTGGCTGATGGTGGATGGCTC (SEQ ID NO: 1198): mut target(-10 +10):
TTGGCTGATGTTGGATGGCTC (SEQ ID NO: 1199): [Model Cell line information]: cell: NCIH661:
cancer type: LUNG: PAM dist: 5: indel length: 0: CRISPR gRNA ID: GF-CCELg9-98: [crRNA sequence]:
crRNA sequence: GATGGGGGGGCTGCGGGCCCTGG (SEQ ID NO: 1202):
SpgRNA: attctaatacgactcactataggGATGGGGGGCTGCGGGCCCgttttagagctagaaatagcaagttaaaataaggctagtccgt
tatcaacttgaaaaagtggcaccgagtcggtgc (SEQ ID NO: 1203): [Target gene information]: Gene ID: 23476:
Symbol: BRD4: Ensembl Transcript ID: EN5T00000263377.2: GRCh: 37: Chr: 19: [Target cancer mutation
information]: mut start: 15353830: mut end: 15353830: mut class: Missense Mutation: mut type: SNP: ref
seq: T: mut seq: G: mut aa: p.Q1017P: mutation info source: CCLE: ref target(-10 +10):
GGGGGGCTGCTGGCCCTGGGG (SEQ ID NO: 1204): mut target(-10 +10):
GGGGGGCTGCGGGCCCTGGGG (SEQ ID NO: 1205): [Model Cell line information]: cell: HCC827GR5:
cancer type: LUNG: PAM dist: 6: indel length: 0: CRISPR gRNA ID: GF-CCELg9-99: [crRNA sequence]:
crRNA sequence: GGGGGCTGCGGGCCCTGGGGTGG (SEQ ID NO: 1206):
SpgRNA: attctaatacgactcactataggGGGGGCTGCGGGCCCTGGGGgttttagagctagaaatagcaagttaaaataaggctagtccgt
tatcaacttgaaaaagtggcaccgagtcggtgc (SEQ ID NO: 1207): [Target gene information]: Gene ID: 23476:
Symbol: BRD4: Ensembl Transcript ID: EN5T00000263377.2: GRCh: 37: Chr: 19: [Target cancer mutation
information]: mut start: 15353830: mut end: 15353830: mut class: Missense Mutation: mut type: SNP: ref
seq: T: mut seq: G: mut aa: p.Q1017P: mutation info source: CCLE: ref target(-10 +10):
GGGGGGCTGCTGGCCCTGGGG (SEQ ID NO: 1204): mut target(-10 +10):
GGGGGGCTGCGGGCCCTGGGG (SEQ ID NO: 1205): [Model Cell line information]: cell: HCC827GR5:
cancer type: LUNG: PAM dist: 11: indel length: 0: CRISPR gRNA ID: GF-CCELg9-100: [crRNA
sequence]: crRNA sequence: GGGGGCGGATGGGGGGGCTGCGG (SEQ ID NO: 1208):
SpgRNA: attctaatacgactcactataggGGGGGCGGATGGGGGGGCTGgttttagagctagaaatagcaagttaaaataaggctagtccg
ttatcaacttgaaaaagtggcaccgagtcggtgc (SEQ ID NO: 1209): [Target gene information]: Gene ID: 23476:
Symbol: BRD4: Ensembl Transcript ID: EN5T00000263377.2: GRCh: 37: Chr: 19: [Target cancer mutation
information]: mut start: 15353830: mut end: 15353830: mut class: Missense Mutation: mut type: SNP: ref
seq: T: mut seq: G: mut aa: p.Q1017P: mutation info source: CCLE: ref target(-10 +10):
GGGGGGCTGCTGGCCCTGGGG (SEQ ID NO: 1204): mut target(-10 +10):
GGGGGGCTGCGGGCCCTGGGG (SEQ ID NO: 1205): [Model Cell line information]: cell: HCC827GR5:
cancer type: LUNG: PAM dist: -1: indel length: 0: CRISPR gRNA ID: GF-CCELg9-101: [crRNA sequence]:
crRNA sequence: GGCTGCGGGCCCTGGGGTGGCGG (SEQ ID NO: 1210):
SpgRNA: attctaatacgactcactataggGGCTGCGGGCCCTGGGGTGGgttttagagctagaaatagcaagttaaaataaggctagtccgt
tatcaacttgaaaaagtggcaccgagtcggtgc (SEQ ID NO: 1211): [Target gene information]: Gene ID: 23476:
Symbol: BRD4: Ensembl Transcript ID: EN5T00000263377.2: GRCh: 37: Chr: 19: [Target cancer mutation
information]: mut start: 15353830: mut end: 15353830: mut class: Missense Mutation: mut type: SNP: ref TABLE 7-continued Illustrative guide RNA sequences for polypeptides comprising Cas9 seq: T: mut seq: G: mut aa: p.Q1017P: mutation info source: CCLE: ref target(-10 +10):
GGGGGGCTGCTGCCCTGGGG (SEQ ID NO: 1204): mut target(-10 +10):
GGGGGGCTGCGGGCCCTGGGG (SEQ ID NO: 1205): [Model Cell line information]: cell: HCC827GR5:
cancer type: LUNG: PAM dist: 14: indel length: 0: CRISPR gRNA ID: GF-CCELg9-102: [crRNA
sequence]: crRNA sequence: GGGGCGGATGGGGGGGCTGCGGG (SEQ ID NO: 1212):
SpgRNA: attctaatacgactcactataggGGGGCGGATGGGGGGGCTGCGgttttagagctagaaatagcaagttaaaataaggctagtccgt
tatcaacttgaaaaagtggcaccgagtcggtgc (SEQ ID NO: 1213): [Target gene information]: Gene ID: 23476:
Symbol: BRD4: Ensembl Transcript ID: EN5T00000263377.2: GRCh: 37: Chr: 19: [Target cancer mutation
information]: mut start: 15353830: mut end: 15353830: mut class: Missense Mutation: mut type: SNP: ref
seq: T: mut seq: G: mut aa: p.Q1017P: mutation info source: CCLE: ref target(-10 +10):
GGGGGGCTGCTGCCCTGGGG (SEQ ID NO: 1204): mut target(-10 +10):
GGGGGGCTGCGGGCCCTGGGG (SEQ ID NO: 1205): [Model Cell line information]: cell: HCC827GR5:
cancer type: LUNG: PAM dist: 0: indel length: 0: CRISPR gRNA ID: GF-CCELg9-103: [crRNA sequence]:
crRNA sequence: ATGGGGGGGCTGCGGGCCCTGGG (SEQ ID NO: 1214):
SpgRNA: attctaatacgactcactataggATGGGGGGGCTGCGGGCCCTGgttttagagctagaaatagcaagttaaaataaggctagtccgt
tatcaacttgaaaaagtggcaccgagtcggtgc (SEQ ID NO: 1215): [Target gene information]: Gene ID: 23476:
Symbol: BRD4: Ensembl Transcript ID: EN5T00000263377.2: GRCh: 37: Chr: 19: [Target cancer mutation
information]: mut start: 15353830: mut end: 15353830: mut class: Missense Mutation: mut type: SNP: ref
seq: T: mut seq: G: mut aa: p.Q1017P: mutation info source: CCLE: ref target(-10 +10):
GGGGGGCTGCTGCCCTGGGG (SEQ ID NO: 1204): mut target(-10 +10):
GGGGGGCTGCGGGCCCTGGGG (SEQ ID NO: 1205): [Model Cell line information]: cell: HCC827GR5:
cancer type: LUNG: PAM dist: 7: indel length: 0: CRISPR gRNA ID: GF-CCELg9-104: [crRNA sequence]:
crRNA sequence: TGGGGGGGCTGCGGGCCCTGGG (SEQ ID NO: 1216):
SpgRNA: attctaatacgactcactataggTGGGGGGGCTGCGGGCCCTGgttttagagctagaaatagcaagttaaaataaggctagtccgt
tatcaacttgaaaaagtggcaccgagtcggtgc (SEQ ID NO: 1217): [Target gene information]: Gene ID: 23476:
Symbol: BRD4: Ensembl Transcript ID: EN5T00000263377.2: GRCh: 37: Chr: 19: [Target cancer mutation
information]: mut start: 15353830: mut end: 15353830: mut class: Missense Mutation: mut type: SNP: ref
seq: T: mut seq: G: mut aa: p.Q1017P: mutation info source: CCLE: ref target(-10 +10):
GGGGGGCTGCTGCCCTGGGG (SEQ ID NO: 1204): mut target(-10 +10):
GGGGGGCTGCGGGCCCTGGGG (SEQ ID NO: 1205): [Model Cell line information]: cell: HCC827GR5:
cancer type: LUNG: PAM dist: 8: indel length: 0: CRISPR gRNA ID: GF-CCELg9-105: [crRNA sequence]:
crRNA sequence: GCTGCGGGCCCTGGGGTGGCGGG (SEQ ID NO: 1218):
SpgRNA: attctaatacgactcactataggGCTGCGGGCCCTGGGGTGGCGgttttagagctagaaatagcaagttaaaataaggctagtccgtt
atcaacttgaaaaagtggcaccgagtcggtgc (SEQ ID NO: 1219): [Target gene information]: Gene ID: 23476:
Symbol: BRD4: Ensembl Transcript ID: EN5T00000263377.2: GRCh: 37: Chr: 19: [Target cancer mutation
information]: mut start: 15353830: mut end: 15353830: mut class: Missense Mutation: mut type: SNP: ref
seq: T: mut seq: G: mut aa: p.Q1017P: mutation info source: CCLE: ref target(-10 +10):
GGGGGGCTGCTGCCCTGGGG (SEQ ID NO: 1204): mut target(-10 +10):
GGGGGGCTGCGGGCCCTGGGG (SEQ ID NO: 1205): [Model Cell line information]: cell: HCC827GR5:
cancer type: LUNG: PAM dist: 15: indel length: 0: CRISPR gRNA ID: GF-CCELg9-106: [crRNA
sequence]: crRNA sequence: CTGCGGGCCCTGGGGTGGCGGGG (SEQ ID NO: 1220):
SpgRNA: attctaatacgactcactataggCTGCGGGCCCTGGGGTGGCGgttttagagctagaaatagcaagttaaaataaggctagtccgtt
atcaacttgaaaaagtggcaccgagtcggtgc (SEQ ID NO: 1221): [Target gene information]: Gene ID: 23476:
Symbol: BRD4: Ensembl Transcript ID: EN5T00000263377.2: GRCh: 37: Chr: 19: [Target cancer mutation
information]: mut start: 15353830: mut end: 15353830: mut class: Missense Mutation: mut type: SNP: ref
seq: T: mut seq: G: mut aa: p.Q1017P: mutation info source: CCLE: ref target(-10 +10):
GGGGGGCTGCTGCCCTGGGG (SEQ ID NO: 1204): mut target(-10 +10):
GGGGGGCTGCGGGCCCTGGGG (SEQ ID NO: 1205): [Model Cell line information]: cell: HCC827GR5:
cancer type: LUNG: PAM dist: 16: indel length: 0: CRISPR gRNA ID: GF-CCELg9-107: [crRNA
sequence]: crRNA sequence: TGCGGGCCCTGGGGTGGCGGGG (SEQ ID NO: 1222):
SpgRNA: attctaatacgactcactataggTGCGGGCCCTGGGGTGGCGGgttttagagctagaaatagcaagttaaaataaggctagtccgt
tatcaacttgaaaaagtggcaccgagtcggtgc (SEQ ID NO: 1223): [Target gene information]: Gene ID: 23476:
Symbol: BRD4: Ensembl Transcript ID: EN5T00000263377.2: GRCh: 37: Chr: 19: [Target cancer mutation
information]: mut start: 15353830: mut end: 15353830: mut class: Missense Mutation: mut type: SNP: ref
seq: T: mut seq: G: mut aa: p.Q1017P: mutation info source: CCLE: ref target(-10 +10):
GGGGGGCTGCTGCCCTGGGG (SEQ ID NO: 1204): mut target(-10 +10):
GGGGGGCTGCGGGCCCTGGGG (SEQ ID NO: 1205): [Model Cell line information]: cell: HCC827GR5:
cancer type: LUNG: PAM dist: 17: indel length: 0: CRISPR gRNA ID: GF-CCELg9-108: [crRNA
sequence]: crRNA sequence: TTGGGGAGCTCTTCTTCTAGTGG (SEQ ID NO: 1224):
SpgRNA: attctaatacgactcactataggTTGGGGAGCTCTTCTTCTAGgttttagagctagaaatagcaagttaaaataaggctagtccgtta
tcaacttgaaaaagtggcaccgagtcggtgc (SEQ ID NO: 1225): [Target gene information]: Gene ID: 83990: Symbol:
BRIP1: Ensembl Transcript ID: EN5T00000259008.2: GRCh: 37: Chr: 17: [Target cancer mutation
information]: mut start: 59770839: mut end: 59770839: mut class: Missense Mutation: mut type: SNP: ref
seq: T: mut seq: G: mut aa: p.I843L: mutation info source: CCLE: ref target(-10 +10):
TCCACTAGAATAAGAGCTCCC (SEQ ID NO: 1226): mut target(-10 +10):
TCCACTAGAAGAAGAGCTCCC (SEQ ID NO: 1227): [Model Cell line information]: cell: NCIH661:
cancer type: LUNG: PAM dist: 7: indel length: 0: CRISPR gRNA ID: GF-CCELg9-109: [crRNA sequence]:
crRNA sequence: TAAGCTTTTTCCACTGCCTGTGG (SEQ ID NO: 1228):
SpgRNA: attctaatacgactcactataggTAAGCTTTTTCCACTGCCTGgttttagagctagaaatagcaagttaaaataaggctagtccgtta
tcaacttgaaaaagtggcaccgagtcggtgc (SEQ ID NO: 1229): [Target gene information]: Gene ID: 83990: Symbol:
BRIP1: Ensembl Transcript ID: EN5T00000259008.2: GRCh: 37: Chr: 17: [Target cancer mutation
information]: mut start: 59937215: mut end: 59937215: mut class: Silent: mut type: SNP: ref seq: T: mut
seq: G: mut aa: p.G49G: mutation info source: CCLE: ref target(-10 +10): TTTTTCCACTTCCTGTGGGAC
(SEQ ID NO: 245): mut target(-10 +10): TTTTTCCACTGCCTGTGGGAC (SEQ ID NO: 246): [Model
Cell line information]: cell: NCIH1975: cancer type: LUNG: PAM dist: 5: indel length: 0: CRISPR gRNA
ID: GF-CCELg9-110: [crRNA sequence]: crRNA sequence: AAGCTTTTTCCACTGCCTGTGGG (SEQ ID
NO: 1230):

TABLE 7-continued

Illustrative guide RNA sequences for polypeptides comprising Cas9

SpgRNA: attctaatacgactcactataggAAGCTTTTTCCACTGCCTGTg agagctagaaatagcaagttaaaataaggctagtccgtta tcaacttgaaaaagtggcaccgagtcggtgc (SEQ ID NO: 1231): [Target gene information]: Gene ID: 83990: Symbol: BRIP1: Ensembl Transcript ID: EN5T00000259008.2: GRCh: 37: Chr: 17: [Target cancer mutation information]: mut start: 59937215: mut end: 59937215: mut class: Silent: mut type: SNP: ref seq: T: mut seq: G: mut aa: p.G49G: mutation info source: CCLE: ref target(-10 +10): TTTTTCCACTTCCTGTGGGAC (SEQ ID NO: 245): mut target(-10 +10): TTTTTCCACTGCCTGTGGGAC (SEQ ID NO: 246): [Model Cell line information]: cell: NCIH1975: cancer type: LUNG: PAM dist: 6: indel length: 0: CRISPR gRNA ID: GF-CCELg9-111: [crRNA sequence]: crRNA sequence: TTGGAGAGTCCCACAGGCAGTGG (SEQ ID NO: 1232):
SpgRNA: attctaatacgactcactataggTTGGAGAGTCCCACAGGCAGgttttagagctagaaatagcaagttaaaataaggctagtccgt tatcaacttgaaaaagtggcaccgagtcggtgc (SEQ ID NO: 1233): [Target gene information]: Gene ID: 83990: Symbol: BRIP1: Ensembl Transcript ID: EN5T00000259008.2: GRCh: 37: Chr: 17: [Target cancer mutation information]: mut start: 59937215: mut end: 59937215: mut class: Silent: mut type: SNP: ref seq: T: mut seq: G: mut aa: p.G49G: mutation info source: CCLE: ref target(-10 +10): TTTTTCCACTTCCTGTGGGAC (SEQ ID NO: 245): mut target(-10 +10): TTTTTCCACTGCCTGTGGGAC (SEQ ID NO: 246): [Model Cell line information]: cell: NCIH1975: cancer type: LUNG: PAM dist: 3: indel length: 0: CRISPR gRNA ID: GF-CCELg9-112: [crRNA sequence]: crRNA sequence: GATTCGGAACCCTGAGTACAAGG (SEQ ID NO: 1234):
SpgRNA: attctaatacgactcactataggGATTCGGAACCCTGAGTACAgttttagagctagaaatagcaagttaaaataaggctagtccgtt atcaacttgaaaaagtggcaccgagtcggtgc (SEQ ID NO: 1235): [Target gene information]: Gene ID: 811: Symbol: CALR: Ensembl Transcript ID: ENST00000316448.5: GRCh: 37: Chr: 19: [Target cancer mutation information]: mut start: 13051452: mut end: 13051452: mut class: Missense Mutation: mut type: SNP: ref seq: A: mut seq: G: mut aa: p.Q267R: mutation info source: CCLE: ref target(-10 +10): CCAGTGATTCAGAACCCTGAG (SEQ ID NO: 1236): mut target(-10 +10): CCAGTGATTCGGAACCCTGAG (SEQ ID NO: 1237): [Model Cell line information]: cell: NCIH661: cancer type: LUNG: PAM dist: 15: indel length: 0: CRISPR gRNA ID: GF-CCELg9-113: [crRNA sequence]: crRNA sequence: AGTGGGAACCCCCAGTGATTCGG (SEQ ID NO: 1238):
SpgRNA: attctaatacgactcactataggAGTGGGAACCCCCAGTGATTgttttagagctagaaatagcaagttaaaataaggctagtccgtt atcaacttgaaaaagtggcaccgagtcggtgc (SEQ ID NO: 1239): [Target gene information]: Gene ID: 811: Symbol: CALR: Ensembl Transcript ID: ENST00000316448.5: GRCh: 37: Chr: 19: [Target cancer mutation information]: mut start: 13051452: mut end: 13051452: mut class: Missense Mutation: mut type: SNP: ref seq: A: mut seq: G: mut aa: p.Q267R: mutation info source: CCLE: ref target(-10 +10): CCAGTGATTCAGAACCCTGAG (SEQ ID NO: 1236): mut target(-10 +10): CCAGTGATTCGGAACCCTGAG (SEQ ID NO: 1237): [Model Cell line information]: cell: NCIH661: cancer type: LUNG: PAM dist: -1: indel length: 0: CRISPR gRNA ID: GF-CCELg9-114: [crRNA sequence]: crRNA sequence: TACTCAGGGTTCCGAATCACTGG (SEQ ID NO: 1240):
SpgRNA: attctaatacgactcactataggTACTCAGGGTTCCGAATCACgttttagagctagaaatagcaagttaaaataaggctagtccgtt atcaacttgaaaaagtggcaccgagtcggtgc (SEQ ID NO: 1241): [Target gene information]: Gene ID: 811: Symbol: CALR: Ensembl Transcript ID: ENST00000316448.5: GRCh: 37: Chr: 19: [Target cancer mutation information]: mut start: 13051452: mut end: 13051452: mut class: Missense Mutation: mut type: SNP: ref seq: A: mut seq: G: mut aa: p.Q267R: mutation info source: CCLE: ref target(-10 +10): CCAGTGATTCAGAACCCTGAG (SEQ ID NO: 1236): mut target(-10 +10): CCAGTGATTCGGAACCCTGAG (SEQ ID NO: 1237): [Model Cell line information]: cell: NCIH661: cancer type: LUNG: PAM dist: 8: indel length: 0: CRISPR gRNA ID: GF-CCELg9-115: [crRNA sequence]: crRNA sequence: ACTCAGGGTTCCGAATCACTGGG (SEQ ID NO: 1242):
SpgRNA: attctaatacgactcactataggACTCAGGGTTCCGAATCACTgttttagagctagaaatagcaagttaaaataaggctagtccgtt atcaacttgaaaaagtggcaccgagtcggtgc (SEQ ID NO: 1243): [Target gene information]: Gene ID: 811: Symbol: CALR: Ensembl Transcript ID: ENST00000316448.5: GRCh: 37: Chr: 19: [Target cancer mutation information]: mut start: 13051452: mut end: 13051452: mut class: Missense Mutation: mut type: SNP: ref seq: A: mut seq: G: mut aa: p.Q267R: mutation info source: CCLE: ref target(-10 +10): CCAGTGATTCAGAACCCTGAG (SEQ ID NO: 1236): mut target(-10 +10): CCAGTGATTCGGAACCCTGAG (SEQ ID NO: 1237): [Model Cell line information]: cell: NCIH661: cancer type: LUNG: PAM dist: 9: indel length: 0: CRISPR gRNA ID: GF-CCELg9-116: [crRNA sequence]: crRNA sequence: CTCAGGGTTCCGAATCACTGGGG (SEQ ID NO: 1244):
SpgRNA: attctaatacgactcactataggCTCAGGGTTCCGAATCACTGgttttagagctagaaatagcaagttaaaataaggctagtccgtt atcaacttgaaaaagtggcaccgagtcggtgc (SEQ ID NO: 1245): [Target gene information]: Gene ID: 811: Symbol: CALR: Ensembl Transcript ID: ENST00000316448.5: GRCh: 37: Chr: 19: [Target cancer mutation information]: mut start: 13051452: mut end: 13051452: mut class: Missense Mutation: mut type: SNP: ref seq: A: mut seq: G: mut aa: p.Q267R: mutation info source: CCLE: ref target(-10 +10): CCAGTGATTCAGAACCCTGAG (SEQ ID NO: 1236): mut target(-10 +10): CCAGTGATTCGGAACCCTGAG (SEQ ID NO: 1237): [Model Cell line information]: cell: NCIH661: cancer type: LUNG: PAM dist: 10: indel length: 0: CRISPR gRNA ID: GF-CCELg9-117: [crRNA sequence]: crRNA sequence: TCAGGGTTCCGAATCACTGGGGG (SEQ ID NO: 1246):
SpgRNA: attctaatacgactcactataggTCAGGGTTCCGAATCACTGGgttttagagctagaaatagcaagttaaaataaggctagtccgtt atcaacttgaaaaagtggcaccgagtcggtgc (SEQ ID NO: 1247): [Target gene information]: Gene ID: 811: Symbol: CALR: Ensembl Transcript ID: ENST00000316448.5: GRCh: 37: Chr: 19: [Target cancer mutation information]: mut start: 13051452: mut end: 13051452: mut class: Missense Mutation: mut type: SNP: ref seq: A: mut seq: G: mut aa: p.Q267R: mutation info source: CCLE: ref target(-10 +10): CCAGTGATTCAGAACCCTGAG (SEQ ID NO: 1236): mut target(-10 +10): CCAGTGATTCGGAACCCTGAG (SEQ ID NO: 1237): [Model Cell line information]: cell: NCIH661: cancer type: LUNG: PAM dist: 11: indel length: 0: CRISPR gRNA ID: GF-CCELg9-118: [crRNA sequence]: crRNA sequence: TCTACGCTGCCCCATATGTCAGG (SEQ ID NO: 1248):
SpgRNA: attctaatacgactcactataggTCTACGCTGCCCCATATGTCgttttagagctagaaatagcaagttaaaataaggctagtccgtta tcaacttgaaaaagtggcaccgagtcggtgc (SEQ ID NO: 1249): [Target gene information]: Gene ID: 84433: Symbol: CARD11: Ensembl Transcript ID: EN5T00000396946.4: GRCh: 37: Chr: 7: [Target cancer mutation information]: mut start: 2946365: mut end: 2946365: mut class: Missense Mutation: mut type: SNP: ref seq: C: mut seq: T: mut aa: p.M1124I: mutation info source: CCLE: ref target(-10 +10): CGCTGCCCCACATGTCAGGTT (SEQ ID NO: 1250): mut target(-10 +10):

TABLE 7-continued

Illustrative guide RNA sequences for polypeptides comprising Cas9

CGCTGCCCCATATGTCAGGTT (SEQ ID NO: 1251): [Model Cell line information]: cell: A549: cancer
type: LUNG: PAM dist: 6: indel length: 0: CRISPR gRNA ID: GF-CCELg9-119: [crRNA sequence]: crRNA
sequence: CCATATGTCAGGTTCCACCGTGG (SEQ ID NO: 1252):
SpgRNA: attctaatacgactcactataggCCATATGTCAGGTTCCACCGgttttagagctagaaatagcaagttaaaataaggctagtccgtt
atcaacttgaaaaagtggcaccgagtcggtgc (SEQ ID NO: 1253): [Target gene information]: Gene ID: 84433:
Symbol: CARD11: Ensembl Transcript ID: EN5T00000396946.4: GRCh: 37: Chr: 7: [Target cancer
mutation information]: mut start: 2946365: mut end: 2946365: mut class: Missense Mutation: mut type: SNP:
ref seq: C: mut seq: T: mut aa: p.M1124I: mutation info source: CCLE: ref target(-10 +10):
CGCTGCCCCACATGTCAGGTT (SEQ ID NO: 1250): mut target(-10 +10):
CGCTGCCCCATATGTCAGGTT (SEQ ID NO: 1251): [Model Cell line information]: cell: A549: cancer
type: LUNG: PAM dist: 17: indel length: 0: CRISPR gRNA ID: GF-CCELg9-120: [crRNA sequence]:
crRNA sequence: TGACATATGGGGCAGCGTAGAGG (SEQ ID NO: 1254):
SpgRNA: attctaatacgactcactataggTGACATATGGGGCAGCGTAGgttttagagctagaaatagcaagttaaaataaggctagtccgt
tatcaacttgaaaaagtggcaccgagtcggtgc (SEQ ID NO: 1255): [Target gene information]: Gene ID: 84433:
Symbol: CARD11: Ensembl Transcript ID: EN5T00000396946.4: GRCh: 37: Chr: 7: [Target cancer
mutation information]: mut start: 2946365: mut end: 2946365: mut class: Missense Mutation: mut type: SNP:
ref seq: C: mut seq: T: mut aa: p.M1124I: mutation info source: CCLE: ref target(-10 +10):
CGCTGCCCCACATGTCAGGTT (SEQ ID NO: 1250): mut target(-10 +10):
CGCTGCCCCATATGTCAGGTT (SEQ ID NO: 1251): [Model Cell line information]: cell: A549: cancer
type: LUNG: PAM dist: 14: indel length: 0: CRISPR gRNA ID: GF-CCELg9-121: [crRNA sequence]:
crRNA sequence: CCACGGTGGAACCTGACATATGG (SEQ ID NO: 1256):
SpgRNA: attctaatacgactcactataggCCACGGTGGAACCTGACATAgttttagagctagaaatagcaagttaaaataaggctagtccgtt
atcaacttgaaaaagtggcaccgagtcggtgc (SEQ ID NO: 1257): [Target gene information]: Gene ID: 84433:
Symbol: CARD11: Ensembl Transcript ID: EN5T00000396946.4: GRCh: 37: Chr: 7: [Target cancer
mutation information]: mut start: 2946365: mut end: 2946365: mut class: Missense Mutation: mut type: SNP:
ref seq: C: mut seq: T: mut aa: p.M1124I: mutation info source: CCLE: ref target(-10 +10):
CGCTGCCCCACATGTCAGGTT (SEQ ID NO: 1250): mut target(-10 +10):
CGCTGCCCCATATGTCAGGTT (SEQ ID NO: 1251): [Model Cell line information]: cell: A549: cancer
type: LUNG: PAM dist: 1: indel length: 0: CRISPR gRNA ID: GF-CCELg9-122: [crRNA sequence]: crRNA
sequence: CACGGTGGAACCTGACATATGGG (SEQ ID NO: 1258):
SpgRNA: attctaatacgactcactataggCACGGTGGAACCTGACATATgttttagagctagaaatagcaagttaaaataaggctagtccgtt
atcaacttgaaaaagtggcaccgagtcggtgc (SEQ ID NO: 1259): [Target gene information]: Gene ID: 84433:
Symbol: CARD11: Ensembl Transcript ID: EN5T00000396946.4: GRCh: 37: Chr: 7: [Target cancer
mutation information]: mut start: 2946365: mut end: 2946365: mut class: Missense Mutation: mut type: SNP:
ref seq: C: mut seq: T: mut aa: p.M1124I: mutation info source: CCLE: ref target(-10 +10):
CGCTGCCCCACATGTCAGGTT (SEQ ID NO: 1250): mut target(-10 +10):
CGCTGCCCCATATGTCAGGTT (SEQ ID NO: 1251): [Model Cell line information]: cell: A549: cancer
type: LUNG: PAM dist: 2: indel length: 0: CRISPR gRNA ID: GF-CCELg9-123: [crRNA sequence]: crRNA
sequence: ACGGTGGAACCTGACATATGGGG (SEQ ID NO: 1260):
SpgRNA: attctaatacgactcactataggACGGTGGAACCTGACATATGgttttagagctagaaatagcaagttaaaataaggctagtccgtt
atcaacttgaaaaagtggcaccgagtcggtgc (SEQ ID NO: 1261): [Target gene information]: Gene ID: 84433:
Symbol: CARD11: Ensembl Transcript ID: EN5T00000396946.4: GRCh: 37: Chr: 7: [Target cancer
mutation information]: mut start: 2946365: mut end: 2946365: mut class: Missense Mutation: mut type: SNP:
ref seq: C: mut seq: T: mut aa: p.M1124I: mutation info source: CCLE: ref target(-10 +10):
CGCTGCCCCACATGTCAGGTT (SEQ ID NO: 1250): mut target(-10 +10):
CGCTGCCCCATATGTCAGGTT (SEQ ID NO: 1251): [Model Cell line information]: cell: A549: cancer
type: LUNG: PAM dist: 3: indel length: 0: CRISPR gRNA ID: GF-CCELg9-124: [crRNA sequence]: crRNA
sequence: GAGAGATTATGGTTACTGGCAGG (SEQ ID NO: 1262):
SpgRNA: attctaatacgactcactataggGAGAGATTATGGTTACTGGCgttttagagctagaaatagcaagttaaaataaggctagtccgtt
atcaacttgaaaaagtggcaccgagtcggtgc (SEQ ID NO: 1263): [Target gene information]: Gene ID: 84433:
Symbol: CARD11: Ensembl Transcript ID: EN5T00000396946.4: GRCh: 37: Chr: 7: [Target cancer
mutation informa-
tion]: mut start: 2974234: mut end: 2974234: mut class: Silent: mut type: SNP: ref seq: G:
mut seq: T: mut aa: p.I457I: mutation info source: CCLE: ref target(-10 +10):
CCTGAGAGATGATGGTTACTG (SEQ ID NO: 1264): mut target(-10 +10):
CCTGAGAGATTATGGTTACTG (SEQ ID NO: 1265): [Model Cell line information]: cell: NCIH661:
cancer type: LUNG: PAM dist: 13: indel length: 0: CRISPR gRNA ID: GF-CCELg9-125: [crRNA sequence]:
crRNA sequence: CCCAAAGTCCTGAGAGATTATGG (SEQ ID NO: 1266):
SpgRNA: attctaatacgactcactataggCCCAAAGTCCTGAGAGATTAgttttagagctagaaatagcaagttaaaataaggctagtccgtt
atcaacttgaaaaagtggcaccgagtcggtgc (SEQ ID NO: 1267): [Target gene information]: Gene ID: 84433:
Symbol: CARD11: Ensembl Transcript ID: EN5T00000396946.4: GRCh: 37: Chr: 7: [Target cancer
mutation informa-
tion]: mut start: 2974234: mut end: 2974234: mut class: Silent: mut type: SNP: ref seq: G:
mut seq: T: mut aa: p.I457I: mutation info source: CCLE: ref target(-10 +10):
CCTGAGAGATGATGGTTACTG (SEQ ID NO: 1264): mut target(-10 +10):
CCTGAGAGATTATGGTTACTG (SEQ ID NO: 1265): [Model Cell line information]: cell: NCIH661:
cancer type: LUNG: PAM dist: 2: indel length: 0: CRISPR gRNA ID: GF-CCELg9-126: [crRNA sequence]:
crRNA sequence: TCCTGAGAGATTATGGTTACTG (SEQ ID NO: 1268):
SpgRNA: attctaatacgactcactataggTCCTGAGAGATTATGGTTACg ttttagagctagaaatagcaagttaaaataaggctagtccgtt
atcaacttgaaaaagtggcaccgagtcggtgc (SEQ ID NO: 1269): [Target gene information]: Gene ID: 84433:
Symbol: CARD11: Ensembl Transcript ID: EN5T00000396946.4: GRCh: 37: Chr: 7: [Target cancer
mutation informa-
tion]: mut start: 2974234: mut end: 2974234: mut class: Silent: mut type: SNP: ref seq: G:
mut seq: T: mut aa: p.I457I: mutation info source: CCLE: ref target(-10 +10):
CCTGAGAGATGATGGTTACTG (SEQ ID NO: 1264): mut target(-10 +10):
CCTGAGAGATTATGGTTACTG (SEQ ID NO: 1265): [Model Cell line information]: cell: NCIH661:
cancer type: LUNG: PAM dist: 9: indel length: 0: CRISPR gRNA ID: GF-CCELg9-127: [crRNA sequence]:
crRNA sequence: TATGGTTACTGGCAGGTTCCTGG (SEQ ID NO: 1270):

TABLE 7-continued

Illustrative guide RNA sequences for polypeptides comprising Cas9

SpgRNA: attctaatacgactcactataggTATGGTTACTGGCAGGTTCCgttttagagctagaaatagcaagttaaaataaggctagtccgtt
atcaacttgaaaaagtggcaccgagtcggtgc (SEQ ID NO: 1271): [Target gene information]: Gene ID: 84433:
Symbol: CARD11: Ensembl Transcript ID: EN5T00000396946.4: GRCh: 37: Chr: 7: [Target cancer
mutation informa-
tion]: mut start: 2974234: mut end: 2974234: mut class: Silent: mut type: SNP: ref seq: G:
mut seq: T: mut aa: p.I457I: mutation info source: CCLE: ref target(-10 +10):
CCTGAGAGATGATGGTTACTG (SEQ ID NO: 1264): mut target(-10 +10):
CCTGAGAGATTATGGTTACTG (SEQ ID NO: 1265): [Model Cell line information]: cell: NCIH661:
cancer type: LUNG: PAM dist: 20: indel length: 0: CRISPR gRNA ID: GF-CCELg9-128: [crRNA sequence]:
crRNA sequence: GCCAGTAACCATAATCTCTCAGG (SEQ ID NO: 1272):
SpgRNA: attctaatacgactcactataggGCCAGTAACCATAATCTCTCgttttagagctagaaatagcaagttaaaataaggctagtccgtt
atcaacttgaaaaagtggcaccgagtcggtgc (SEQ ID NO: 1273): [Target gene information]: Gene ID: 84433:
Symbol: CARD11: Ensembl Transcript ID: EN5T00000396946.4: GRCh: 37: Chr: 7: [Target cancer
mutation informa-
tion]: mut start: 2974234: mut end: 2974234: mut class: Silent: mut type: SNP: ref seq: G:
mut seq: T: mut aa: p.I457I: mutation info source: CCLE: ref target(-10 +10):
CCTGAGAGATGATGGTTACTG (SEQ ID NO: 1264): mut target(-10 +10):
CCTGAGAGATTATGGTTACTG (SEQ ID NO: 1265): [Model Cell line information]: cell: NCIH661:
cancer type: LUNG: PAM dist: 8: indel length: 0: CRISPR gRNA ID: GF-CCELg9-129: [crRNA sequence]:
crRNA sequence: ACCATAATCTCTCAGGACTTTGG (SEQ ID NO: 1274):
SpgRNA: attctaatacgactcactataggACCATAATCTCTCAGGACTTgttttagagctagaaatagcaagttaaaataaggctagtccgtt
atcaacttgaaaaagtggcaccgagtcggtgc (SEQ ID NO: 1275): [Target gene information]: Gene ID: 84433:
Symbol: CARD11: Ensembl Transcript ID: ENST00000396946.4: GRCh: 37: Chr: 7: [Target cancer
mutation informa-
tion]: mut start: 2974234: mut end: 2974234: mut class: Silent: mut type: SNP: ref seq: G:
mut seq: T: mut aa: p.I457I: mutation info source: CCLE: ref target(-10 +10):
CCTGAGAGATGATGGTTACTG (SEQ ID NO: 1264): mut target(-10 +10):
CCTGAGAGATTATGGTTACTG (SEQ ID NO: 1265): [Model Cell line information]: cell: NCIH661:
cancer type: LUNG: PAM dist: 15: indel length: 0: CRISPR gRNA ID: GF-CCELg9-130: [crRNA sequence]:
crRNA sequence: CCATAATCTCTCAGGACTTTGGG (SEQ ID NO: 1276):
SpgRNA: attctaatacgactcactataggCCATAATCTCTCAGGACTTTgttttagagctagaaatagcaagttaaaataaggctagtccgtta
tcaacttgaaaaagtggcaccgagtcggtgc (SEQ ID NO: 1277): [Target gene information]: Gene ID: 84433: Symbol:
CARD11: Ensembl Transcript ID: EN5T00000396946.4: GRCh: 37: Chr: 7: [Target cancer mutation
informa-
tion]: mut start: 2974234: mut end: 2974234: mut class: Silent: mut type: SNP: ref seq: G: mut seq:
T: mut aa: p.I457I: mutation info source: CCLE: ref target(-10 +10): CCTGAGAGATGATGGTTACTG
(SEQ ID NO: 1264): mut target(-10 +10): CCTGAGAGATTATGGTTACTG (SEQ ID NO: 1265): [Model
Cell line information]: cell: NCIH661: cancer type: LUNG: PAM dist: 16: indel length: 0: CRISPR gRNA
ID: GF-CCELg9-131: [crRNA sequence]: crRNA sequence: CATAATCTCTCAGGACTTTGGGG (SEQ ID
NO: 1278):
SpgRNA: attctaatacgactcactataggCATAATCTCTCAGGACTTTGgttttagagctagaaatagcaagttaaaataaggctagtccgtt
atcaacttgaaaaagtggcaccgagtcggtgc (SEQ ID NO: 1279): [Target gene information]: Gene ID: 84433:
Symbol: CARD11: Ensembl Transcript ID: EN5T00000396946.4: GRCh: 37: Chr: 7: [Target cancer
mutation informa-
tion]: mut start: 2974234: mut end: 2974234: mut class: Silent: mut type: SNP: ref seq: G:
mut seq: T: mut aa: p.I457I: mutation info source: CCLE: ref target(-10 +10):
CCTGAGAGATGATGGTTACTG (SEQ ID NO: 1264): mut target(-10 +10):
CCTGAGAGATTATGGTTACTG (SEQ ID NO: 1265): [Model Cell line information]: cell: NCIH661:
cancer type: LUNG: PAM dist: 17: indel length: 0: CRISPR gRNA ID: GF-CCELg9-132: [crRNA sequence]:
crRNA sequence: GAGGGGTGGCAGCCTGTTGAGG (SEQ ID NO: 1280):
SpgRNA: attctaatacgactcactataggGAGGGGGTGGCAGCCTGTTGgttttagagctagaaatagcaagttaaaataaggctagtccgt
tatcaacttgaaaaagtggcaccgagtcggtgc (SEQ ID NO: 1281): [Target gene information]: Gene ID: 867: Symbol:
CBL: Ensembl Transcript ID: EN5T00000264033.4: GRCh: 37: Chr: 11: [Target cancer mutation
information]: mut start: 119149307: mut end: 119149307: mut class: Missense Mutation: mut type: SNP: ref
seq: A: mut seq: G: mut aa: p.S439G: mutation info source: CCLE: ref target(-10 +10):
TCCTAGAGGGAGTGGCAGCCT (SEQ ID NO: 261): mut target(-10 +10):
TCCTAGAGGGGGTGGCAGCCT (SEQ ID NO: 262): [Model Cell line information]: cell: NCIH1563:
cancer type: LUNG: PAM dist: 15: indel length: 0: CRISPR gRNA ID: GF-CCELg9-133: [crRNA sequence]:
crRNA sequence: GGTGGCAGCCTGTTGAGGCAAGG (SEQ ID NO: 1282):
SpgRNA: attctaatacgactcactataggGGTGGCAGCCTGTTGAGGCAgttttagagctagaaatagcaagttaaaataaggctagtccgtt
atcaacttgaaaaagtggcaccgagtcggtgc (SEQ ID NO: 1283): [Target gene information]: Gene ID: 867: Symbol:
CBL: Ensembl Transcript ID: ENST00000264033.4: GRCh: 37: Chr: 11: [Target cancer mutation
information]: mut start: 119149307: mut end: 119149307: mut class: Missense Mutation: mut type: SNP: ref
seq: A: mut seq: G: mut aa: p.S439G: mutation info source: CCLE: ref target(-10 +10):
TCCTAGAGGGAGTGGCAGCCT (SEQ ID NO: 261): mut target(-10 +10):
TCCTAGAGGGGGTGGCAGCCT (SEQ ID NO: 262): [Model Cell line information]: cell: NCIH1563:
cancer type: LUNG: PAM dist: 20: indel length: 0: CRISPR gRNA ID: GF-CCELg9-134: [crRNA sequence]:
crRNA sequence: CCGTTTGATCCTAGAGGGGGTGG (SEQ ID NO: 1284):
SpgRNA: attctaatacgactcactataggCCGTTTGATCCTAGAGGGGGgttttagagctagaaatagcaagttaaaataaggctagtccgtt
atcaacttgaaaaagtggcaccgagtcggtgc (SEQ ID NO: 1285): [Target gene information]: Gene ID: 867: Symbol:
CBL: Ensembl Transcript ID: EN5T00000264033.4: GRCh: 37: Chr: 11: [Target cancer mutation
information]: mut start: 119149307: mut end: 119149307: mut class: Missense Mutation: mut type: SNP: ref
seq: A: mut seq: G: mut aa: p.S439G: mutation info source: CCLE: ref target(-10 +10):
TCCTAGAGGGAGTGGCAGCCT (SEQ ID NO: 261): mut target(-10 +10):
TCCTAGAGGGGGTGGCAGCCT (SEQ ID NO: 262): [Model Cell line information]: cell: NCIH1563:
cancer type: LUNG: PAM dist: 2: indel length: 0: CRISPR gRNA ID: GF-CCELg9-135: [crRNA sequence]:
crRNA sequence: GATCCGTTTGATCCTAGAGGGG (SEQ ID NO: 1286):

TABLE 7-continued

Illustrative guide RNA sequences for polypeptides comprising Cas9

SpgRNA: attctaatacgactcactataggGATCCGTTTGATCCTAGAGGgttttagagctagaaatagcaagttaaaataaggctagtccgtt
atcaacttgaaaaagtggcaccgagtcggtgc (SEQ ID NO: 1287): [Target gene information]: Gene ID: 867: Symbol:
CBL: Ensembl Transcript ID: EN5T00000264033.4: GRCh: 37: Chr: 11: [Target cancer mutation
information]: mut start: 119149307: mut end: 119149307: mut class: Missense Mutation: mut type: SNP: ref
seq: A: mut seq: G: mut aa: p.S439G: mutation info source: CCLE: ref target(-10 +10):
TCCTAGAGGGAGTGGCAGCCT (SEQ ID NO: 261): mut target(-10 +10):
TCCTAGAGGGGGTGGCAGCCT (SEQ ID NO: 262): [Model Cell line information]: cell: NCIH1563:
cancer type: LUNG: PAM dist: -1: indel length: 0: CRISPR gRNA ID: GF-CCELg9-136: [crRNA sequence]:
crRNA sequence: AACAGGCTGCCACCCCCTCTAGG (SEQ ID NO: 1288):
SpgRNA: attctaatacgactcactataggAACAGGCTGCCACCCCCTCTgttttagagctagaaatagcaagttaaaataaggctagtccgtt
atcaacttgaaaaagtggcaccgagtcggtgc (SEQ ID NO: 1289): [Target gene information]: Gene ID: 867: Symbol:
CBL: Ensembl Transcript ID: ENST00000264033.4: GRCh: 37: Chr: 11: [Target cancer mutation
information]: mut start: 119149307: mut end: 119149307: mut class: Missense Mutation: mut type: SNP: ref
seq: A: mut seq: G: mut aa: p.S439G: mutation info source: CCLE: ref target(-10 +10):
TCCTAGAGGGAGTGGCAGCCT (SEQ ID NO: 261): mut target(-10 +10):
TCCTAGAGGGGGTGGCAGCCT (SEQ ID NO: 262): [Model Cell line information]: cell: NCIH1563:
cancer type: LUNG: PAM dist: 7: indel length: 0: CRISPR gRNA ID: GF-CCELg9-137: [crRNA sequence]:
crRNA sequence: CCACCCCCTCTAGGATCAAACGG (SEQ ID NO: 1290):
SpgRNA: attctaatacgactcactataggCCACCCCCTCTAGGATCAAACGgttttagagctagaaatagcaagttaaaataaggctagtccgtt
atcaacttgaaaaagtggcaccgagtcggtgc (SEQ ID NO: 1291): [Target gene information]: Gene ID: 867: Symbol:
CBL: Ensembl Transcript ID: ENST00000264033.4: GRCh: 37: Chr: 11: [Target cancer mutation
information]: mut start: 119149307: mut end: 119149307: mut class: Missense Mutation: mut type: SNP: ref
seq: A: mut seq: G: mut aa: p.S439G: mutation info source: CCLE: ref target(-10 +10):
TCCTAGAGGGAGTGGCAGCCT (SEQ ID NO: 261): mut target(-10 +10):
TCCTAGAGGGGGTGGCAGCCT (SEQ ID NO: 262): [Model Cell line information]: cell: NCIH1563:
cancer type: LUNG: PAM dist: 16: indel length: 0: CRISPR gRNA ID: GF-CCELg9-138: [crRNA sequence]:
crRNA sequence: TCTGGAGACTCACTTGTGGTAGG (SEQ ID NO: 1292):
SpgRNA: attctaatacgactcactataggTCTGGAGACTCACTTGTGGTgttttagagctagaaatagcaagttaaaataaggctagtccgtt
atcaacttgaaaaagtggcaccgagtcggtgc (SEQ ID NO: 1293): [Target gene information]: Gene ID: 867: Symbol:
CBL: Ensembl Transcript ID: EN5T00000264033.4: GRCh: 37: Chr: 11: [Target cancer mutation
information]: mut start: 119169246: mut end: 119169246: mut class: Silent: mut type: SNP: ref seq: A: mut
seq: C: mut aa: p.T810T: mutation info source: CCLE: ref target(-10 +10):
GTGATCCTACAACAAGTGAGT (SEQ ID NO: 1294): mut target(-10 +10):
GTGATCCTACCACAAGTGAGT (SEQ ID NO: 1295): [Model Cell line information]: cell: NCIH1563:
cancer type: LUNG: PAM dist: 3: indel length: 0: CRISPR gRNA ID: GF-CCELg9-139: [crRNA sequence]:
crRNA sequence: GTAGTCTGGAGACTCACTTGTGG (SEQ ID NO: 1296):
SpgRNA: attctaatacgactcactataggGTAGTCTGGAGACTCACTTGgttttagagctagaaatagcaagttaaaataaggctagtccgtt
atcaacttgaaaaagtggcaccgagtcggtgc (SEQ ID NO: 1297): [Target gene information]: Gene ID: 867: Symbol:
CBL: Ensembl Transcript ID: EN5T00000264033.4: GRCh: 37: Chr: 11: [Target cancer mutation
information]: mut start: 119169246: mut end: 119169246: mut class: Silent: mut type: SNP: ref seq: A: mut
seq: C: mut aa: p.T810T: mutation info source: CCLE: ref target(-10 +10):
GTGATCCTACAACAAGTGAGT (SEQ ID NO: 1294): mut target(-10 +10):
GTGATCCTACCACAAGTGAGT (SEQ ID NO: 1295): [Model Cell line information]: cell: NCIH1563:
cancer type: LUNG: PAM dist: -1: indel length: 0: CRISPR gRNA ID: GF-CCELg9-140: [crRNA sequence]:
crRNA sequence: TTTCACCGAAGGCCGGAACCAGG (SEQ ID NO: 1298):
SpgRNA: attctaatacgactcactataggTTTCACCGAAGGCCGGAACCgttttagagctagaaatagcaagttaaaataaggctagtccgtt
atcaacttgaaaaagtggcaccgagtcggtgc (SEQ ID NO: 1299): [Target gene information]: Gene ID: 80381:
Symbol: CD276: Ensembl Transcript ID: ENST00000318443.5: GRCh: 37: Chr: 15: [Target cancer mutation
information]: mut start: 73996170: mut end: 73996170: mut class: Missense Mutation: mut type: SNP: ref
seq: G: mut seq: A: mut aa: p.D302N: mutation info source: CCLE: ref target(-10 +10):
CGAAGGCCGGGACCAGGGCAG (SEQ ID NO: 265): mut target(-10 +10):
CGAAGGCCGGAACCAGGGCAG (SEQ ID NO: 266): [Model Cell line information]: cell: NCIH1573:
cancer type: LUNG: PAM dist: 4: indel length: 0: CRISPR gRNA ID: GF-CCELg9-141: [crRNA sequence]:
crRNA sequence: TTCACCGAAGGCCGGAACCAGGG (SEQ ID NO: 1300):
SpgRNA: attctaatacgactcactataggTTCACCGAAGGCCGGAACCAgttttagagctagaaatagcaagttaaaataaggctagtccgt
tatcaacttgaaaaagtggcaccgagtcggtgc (SEQ ID NO: 1301): [Target gene information]: Gene ID: 80381:
Symbol: CD276: Ensembl Transcript ID: ENST00000318443.5: GRCh: 37: Chr: 15: [Target cancer mutation
information]: mut start: 73996170: mut end: 73996170: mut class: Missense Mutation: mut type: SNP: ref
seq: G: mut seq: A: mut aa: p.D302N: mutation info source: CCLE: ref target(-10 +10):
CGAAGGCCGGGACCAGGGCAG (SEQ ID NO: 265): mut target(-10 +10):
CGAAGGCCGGAACCAGGGCAG (SEQ ID NO: 266): [Model Cell line information]: cell: NCIH1573:
cancer type: LUNG: PAM dist: 5: indel length: 0: CRISPR gRNA ID: GF-CCELg9-142: [crRNA sequence]:
crRNA sequence: CATAGGCGCTGCCCTGGTTCCGG (SEQ ID NO: 1302):
SpgRNA: attctaatacgactcactataggCATAGGCGCTGCCCTGGTTCgttttagagctagaaatagcaagttaaaataaggctagtccgtt
atcaacttgaaaaagtggcaccgagtcggtgc (SEQ ID NO: 1303): [Target gene information]: Gene ID: 80381:
Symbol: CD276: Ensembl Transcript ID: ENST00000318443.5: GRCh: 37: Chr: 15: [Target cancer mutation
information]: mut start: 73996170: mut end: 73996170: mut class: Missense Mutation: mut type: SNP: ref
seq: G: mut seq: A: mut aa: p.D302N: mutation info source: CCLE: ref target(-10 +10):
CGAAGGCCGGGACCAGGGCAG (SEQ ID NO: 265): mut target(-10 +10):
CGAAGGCCGGAACCAGGGCAG (SEQ ID NO: 266): [Model Cell line information]: cell: NCIH1573:
cancer type: LUNG: PAM dist: 2: indel length: 0: CRISPR gRNA ID: GF-CCELg9-143: [crRNA sequence]:
crRNA sequence: GCTGCCCTGGTTCCGGCCTTCGG (SEQ ID NO: 1304):
SpgRNA: attctaatacgactcactataggGCTGCCCTGGTTCCGGCCTTgttttagagctagaaatagcaagttaaaataaggctagtccgtta
tcaacttgaaaaagtggcaccgagtcggtgc (SEQ ID NO: 1305): [Target gene information]: Gene ID: 80381: Symbol:
CD276: Ensembl Transcript ID: ENST00000318443.5: GRCh: 37: Chr: 15: [Target cancer mutation
information]: mut start: 73996170: mut end: 73996170: mut class: Missense Mutation: mut type: SNP: ref
seq: G: mut seq: A: mut aa: p.D302N: mutation info source: CCLE: ref target(-10 +10):
CGAAGGCCGGGACCAGGGCAG (SEQ ID NO: 265): mut target(-10 +10):

TABLE 7-continued

Illustrative guide RNA sequences for polypeptides comprising Cas9

CGAAGGCCGGAACCAGGGCAG (SEQ ID NO: 266): [Model Cell line information]: cell: NCIH1573:
cancer type: LUNG: PAM dist: 9: indel length: 0: CRISPR gRNA ID: GF-CCELg9-144: [crRNA sequence]:
crRNA sequence: AGATCATCAGTCCTCAACTGAGG (SEQ ID NO: 1306):
SpgRNA: attctaatacgactcactataggAGATCATCAGTCCTCAACTGgttttagagctagaaatagcaagttaaaataaggctagtccgtt
atcaacttgaaaaagtggcaccgagtcggtgc (SEQ ID NO: 1307): [Target gene information]: Gene ID: 1029: Symbol:
CDKN2A: Ensembl Transcript ID: EN5T00000304494.5: GRCh: 37: Chr: 9: [Target cancer mutation
information]: mut start: 21970900: mut end: 21970900: mut class: Splice Site: mut type: SNP: ref seq: C:
mut seq: A: mut aa: -: mutation info source: CCLE: ref target(-10 +10): TCAGTCCTCACCTGAGGGACC
(SEQ ID NO: 1308): mut target(-10 +10): TCAGTCCTCAACTGAGGGACC (SEQ ID NO: 1309): [Model
Cell line information]: cell: NCIH661: cancer type: LUNG: PAM dist: 4: indel length: 0: CRISPR gRNA ID:
GF-CCELg9-145: [crRNA sequence]: crRNA sequence: CTCAACTGAGGGACCTTCCGCGG (SEQ ID
NO: 1310):
SpgRNA: attctaatacgactcactataggCTCAACTGAGGGACCTTCCGgttttagagctagaaatagcaagttaaaataaggctagtccgtt
atcaacttgaaaaagtggcaccgagtcggtgc (SEQ ID NO: 1311): [Target gene information]: Gene ID: 1029: Symbol:
CDKN2A: Ensembl Transcript ID: EN5T00000304494.5: GRCh: 37: Chr: 9: [Target cancer mutation
information]: mut start: 21970900: mut end: 21970900: mut class: Splice Site: mut type: SNP: ref seq: C:
mut seq: A: mut aa: -: mutation info source: CCLE: ref target(-10 +10): TCAGTCCTCACCTGAGGGACC
(SEQ ID NO: 1308): mut target(-10 +10): TCAGTCCTCAACTGAGGGACC (SEQ ID NO: 1309): [Model
Cell line information]: cell: NCIH661: cancer type: LUNG: PAM dist: 16: indel length: 0: CRISPR gRNA
ID: GF-CCELg9-146: [crRNA sequence]: crRNA sequence: GATCATCAGTCCTCAACTGAGGG (SEQ ID
NO: 1312):
SpgRNA: attctaatacgactcactataggGATCATCAGTCCTCAACTGAg agagctagaaatagcaagttaaaataaggctagtccgtt
atcaacttgaaaaagtggcaccgagtcggtgc (SEQ ID NO: 1313): [Target gene information]: Gene ID: 1029: Symbol:
CDKN2A: Ensembl Transcript ID: EN5T00000304494.5: GRCh: 37: Chr: 9: [Target cancer mutation
information]: mut start: 21970900: mut end: 21970900: mut class: Splice Site: mut type: SNP: ref seq: C:
mut seq: A: mut aa: -: mutation info source: CCLE: ref target(-10 +10): TCAGTCCTCACCTGAGGGACC
(SEQ ID NO: 1308): mut target(-10 +10): TCAGTCCTCAACTGAGGGACC (SEQ ID NO: 1309): [Model
Cell line information]: cell: NCIH661: cancer type: LUNG: PAM dist: 5: indel length: 0: CRISPR gRNA ID:
GF-CCELg9-147: [crRNA sequence]: crRNA sequence: CGCGGAAGGTCCCTCAGTTGAGG (SEQ ID
NO: 1314):
SpgRNA: attctaatacgactcactataggCGCGGAAGGTCCCTCAGTTGgittttagagctagaaatagcaagttaaaataaggctagtccgtt
atcaacttgaaaaagtggcaccgagtcggtgc (SEQ ID NO: 1315): [Target gene information]: Gene ID: 1029: Symbol:
CDKN2A: Ensembl Transcript ID: ENST00000304494.5: GRCh: 37: Chr: 9: [Target cancer mutation
information]: mut start: 21970900: mut end: 21970900: mut class: Splice Site: mut type: SNP: ref seq: C:
mut seq: A: mut aa: -: mutation info source: CCLE: ref target(-10 +10): TCAGTCCTCACCTGAGGGACC
(SEQ ID NO: 1308): mut target(-10 +10): TCAGTCCTCAACTGAGGGACC (SEQ ID NO: 1309): [Model
Cell line information]: cell: NCIH661: cancer type: LUNG: PAM dist: 3: indel length: 0: CRISPR gRNA ID:
GF-CCELg9-148: [crRNA sequence]: crRNA sequence: CGCAGTTGGGCTACGCGCCGTGG (SEQ ID
NO: 1316):
SpgRNA: attctaatacgactcactataggCGCAGTTGGGCTACGCGCCGg agagctagaaatagcaagttaaaataaggctagtccgtt
atcaacttgaaaaagtggcaccgagtcggtgc (SEQ ID NO: 1317): [Target gene information]: Gene ID: 1029: Symbol:
CDKN2A: Ensembl Transcript ID: EN5T00000304494.5: GRCh: 37: Chr: 9: [Target cancer mutation
information]: mut start: 21971153: mut end: 21971153: mut class: Nonsense Mutation: mut type: SNP: ref
seq: C: mut seq: A: mut aa: p.E69*: mutation info source: CCLE: ref target(-10 +10):
CAGTTGGGCTCCGCGCCGTGG (SEQ ID NO: 1318): mut target(-10 +10):
CAGTTGGGCTACGCGCCGTGG (SEQ ID NO: 1319): [Model Cell line information]: cell: NCIH1975:
cancer type: LUNG: PAM dist: 8: indel length: 0: CRISPR gRNA ID: GF-CCELg9-149: [crRNA sequence]:
crRNA sequence: CCACCTCCTCTACCCGACCCGG (SEQ ID NO: 1320):
SpgRNA: attctaatacgactcactataggCCACCTCCTCTACCCGACCCgttttagagctagaaatagcaagttaaaataaggctagtccgtt
atcaacttgaaaaagtggcaccgagtcggtgc (SEQ ID NO: 1321): [Target gene information]: Gene ID: 1029: Symbol:
CDKN2A: Ensembl Transcript ID: EN5T00000304494.5: GRCh: 37: Chr: 9: [Target cancer mutation
information]: mut start: 21974725: mut end: 21974742: mut class: In Frame Del: mut type: DEL: ref seq:
CGCCTCCAGCAGCGCCCG (SEQ ID NO: 1322): mut seq: -: mut aa: p.RALLEA29del ("RALLEA"
disclosed as SEQ ID NO: 1323): mutation info source: CCLE: ref target(-10 +10):
GCAGCGCCCCCGCCTCCAGCAGCGCCCGCACCTCCTCT (SEQ ID NO: 1324): mut target(-10 +10):
GCAGCGCCCC------------------CACCTCCTCT (SEQ ID NO: 1325): [Model Cell line information]: cell:
HPAFII: cancer type: PANCREAS: PAM dist: 20: indel length: 18: CRISPR gRNA ID: GF-CCELg9-150:
[crRNA sequence]: crRNA sequence: CCGGGGTCGGGTAGAGGAGGTGG (SEQ ID NO: 1326):
SpgRNA: attctaatacgactcactataggCCGGGGTCGGGTAGAGGAGGgttttagagctagaaatagcaagttaaaataaggctagtccgt
tatcaacttgaaaaagtggcaccgagtcggtgc (SEQ ID NO: 1327): [Target gene information]: Gene ID: 1029: Symbol:
CDKN2A: Ensembl Transcript ID: EN5T00000304494.5: GRCh: 37: Chr: 9: [Target cancer mutation
information]: mut start: 21974725: mut end: 21974742: mut class: In Frame Del: mut type: DEL: ref seq:
CGCCTCCAGCAGCGCCCG (SEQ ID NO: 1322): mut seq: -: mut aa: p.RALLEA29del ("RALLEA"
disclosed as SEQ ID NO: 1323): mutation info source: CCLE: ref target(-10 +10):
GCAGCGCCCCGCCTCCAGCAGCGCCCGCACCTCCTCT (SEQ ID NO: 1324): mut target(-10 +10):
GCAGCGCCCCACCTCCTCT (SEQ ID NO: 1325): [Model Cell line information]: cell:
HPAFII: cancer type: PANCREAS: PAM dist: -1: indel length: 18: CRISPR gRNA ID: GF-CCELg9-151:
[crRNA sequence]: crRNA sequence: CGGGGTCGGGTAGAGGAGGTGGG (SEQ ID NO: 1328):
SpgRNA: attctaatacgactcactataggCGGGGTCGGGTAGAGGAGGTgttttagagctagaaatagcaagttaaaataaggctagtccgt
tatcaacttgaaaaagtggcaccgagtcggtgc (SEQ ID NO: 1329): [Target gene information]: Gene ID: 1029: Symbol:
CDKN2A: Ensembl Transcript ID: ENST00000304494.5: GRCh: 37: Chr: 9: [Target cancer mutation
information]: mut start: 21974725: mut end: 21974742: mut class: In Frame Del: mut type: DEL: ref seq:
CGCCTCCAGCAGCGCCCG (SEQ ID NO: 1322): mut seq: -: mut aa: p.RALLEA29del ("RALLEA"
disclosed as SEQ ID NO: 1323): mutation info source: CCLE: ref target(-10 +10):
GCAGCGCCCCCGCCTCCAGCAGCGCCCGCACCTCCTCT (SEQ ID NO: 1324): mut target(-10 +10):
GCAGCGCCCC------------------CACCTCCTCT (SEQ ID NO: 1325): [Model Cell line information]: cell:
HPAFII: cancer type: PANCREAS: PAM dist: 0: indel length: 18: CRISPR gRNA ID: GF-CCELg9-152:
[crRNA sequence]: crRNA sequence: GGGGTCGGGTAGAGGAGGTGGGG (SEQ ID NO: 1330):

TABLE 7-continued

Illustrative guide RNA sequences for polypeptides comprising Cas9

SpgRNA: attctaatacgactcactataggGGGGTCGGGTAGAGGAGGTGgttttagagctagaaatagcaagttaaaataaggctagtccgt
tatcaacttgaaaaagtggcaccgagtcggtgc (SEQ ID NO: 133 1): [Target gene information]: Gene ID: 1029: Symbol:
CDKN2A: Ensembl Transcript ID: EN5T00000304494.5: GRCh: 37: Chr: 9: [Target cancer mutation
information]: mut start: 21974725: mut end: 21974742: mut class: In Frame Del: mut type: DEL: ref seq:
CGCCTCCAGCAGCGCCCG (SEQ ID NO: 1322): mut seq: -: mut aa: p.RALLEA29del ("RALLEA"
disclosed as SEQ ID NO: 1323): mutation info source: CCLE: ref target(-10 +10):
GCAGCGCCCCCGCCTCCAGCAGCGCCCGCACCTCCTCT (SEQ ID NO: 1324): mut target(-10 +10):
GCAGCGCCCC------------------CACCTCCTCT (SEQ ID NO: 1325): [Model Cell line information]: cell:
HPAFII: cancer type: PANCREAS: PAM dist: 1: indel length: 18: CRISPR gRNA ID: GF-CCELg9-153:
[crRNA sequence]: crRNA sequence: GGGTCGGGTAGAGGAGGTGGGGG (SEQ ID NO: 1332):
SpgRNA: attctaatacgactcactataggGGGTCGGGTAGAGGAGGTGGgttttagagctagaaatagcaagttaaaataaggctagtccgt
tatcaacttgaaaaagtggcaccgagtcggtgc (SEQ ID NO: 1333): [Target gene information]: Gene ID: 1029: Symbol:
CDKN2A: Ensembl Transcript ID: EN5T00000304494.5: GRCh: 37: Chr: 9: [Target cancer mutation
information]: mut start: 21974725: mut end: 21974742: mut class: In Frame Del: mut type: DEL: ref seq:
CGCCTCCAGCAGCGCCCG (SEQ ID NO: 1322): mut seq: -: mut aa: p.RALLEA29del ("RALLEA"
disclosed as SEQ ID NO: 1323): mutation info source: CCLE: ref target(-10 +10):
GCAGCGCCCCCGCCTCCAGCAGCGCCCGCACCTCCTCT (SEQ ID NO: 1324): mut target(-10 +10):
GCAGCGCCCC------------------CACCTCCTCT (SEQ ID NO: 1325): [Model Cell line information]: cell:
HPAFII: cancer type: PANCREAS: PAM dist: 2: indel length: 18: CRISPR gRNA ID: GF-CCELg9-154:
[crRNA sequence]: crRNA sequence: CATTCCCGTGGTGTCCTTTGAGG (SEQ ID NO: 1334):
SpgRNA: attctaatacgactcactataggCATTCCCGTGGTGTCCTTTGAGgagctagaaatagcaagttaaaataaggctagtccgtta
tcaacttgaaaaagtggcaccgagtcggtgc (SEQ ID NO: 1335): [Target gene information]: Gene ID: 23152: Symbol:
CIC: Ensembl Transcript ID: ENST00000575354.2: GRCh: 37: Chr: 19: [Target cancer mutation
information]: mut start: 42797207: mut end: 42797207: mut class: Missense Mutation: mut type: SNP: ref
seq: G: mut seq: T: mut aa: p.G1190V: mutation info source: CCLE: ref target(-10 +10):
ATTCCCGTGGGGTCCTTTGAG (SEQ ID NO: 1336): mut target(-10 +10):
ATTCCCGTGGTGTCCTTTGAG (SEQ ID NO: 1337): [Model Cell line information]: cell: NCIH1573:
cancer type: LUNG: PAM dist: 9: indel length: 0: CRISPR gRNA ID: GF-CCELg9-155: [crRNA sequence]:
crRNA sequence: CCCGTGGTGTCCTTTGAGGCAGG (SEQ ID NO: 1338):
SpgRNA: attctaatacgactcactataggCCCGTGGTGTCCTTTGAGGCgttttagagctagaaatagcaagttaaaataaggctagtccgtt
atcaacttgaaaaagtggcaccgagtcggtgc (SEQ ID NO: 1339): [Target gene information]: Gene ID: 23152:
Symbol: CIC: Ensembl Transcript ID: ENST00000575354.2: GRCh: 37: Chr: 19: [Target cancer mutation
information]: mut start: 42797207: mut end: 42797207: mut class: Missense Mutation: mut type: SNP: ref
seq: G: mut seq: T: mut aa: p.G1190V: mutation info source: CCLE: ref target(-10 +10):
ATTCCCGTGGGGTCCTTTGAG (SEQ ID NO: 1336): mut target(-10 +10):
ATTCCCGTGGTGTCCTTTGAG (SEQ ID NO: 1337): [Model Cell line information]: cell: NCIH1573:
cancer type: LUNG: PAM dist: 13: indel length: 0: CRISPR gRNA ID: GF-CCELg9-156: [crRNA sequence]:
crRNA sequence: AAAGGACACCACGGGAATGCTGG (SEQ ID NO: 1340):
SpgRNA: attctaatacgactcactataggAAAGGACACCACGGGAATGCgttttagagctagaaatagcaagttaaaataaggctagtccgt
tatcaacttgaaaaagtggcaccgagtcggtgc (SEQ ID NO: 1341): [Target gene information]: Gene ID: 23152:
Symbol: CIC: Ensembl Transcript ID: EN5T00000575354.2: GRCh: 37: Chr: 19: [Target cancer mutation
information]: mut start: 42797207: mut end: 42797207: mut class: Missense Mutation: mut type: SNP: ref
seq: G: mut seq: T: mut aa: p.G1190V: mutation info source: CCLE: ref target(-10 +10):
ATTCCCGTGGGGTCCTTTGAG (SEQ ID NO: 1336): mut target(-10 +10):
ATTCCCGTGGTGTCCTTTGAG (SEQ ID NO: 1337): [Model Cell line information]: cell: NCIH1573:
cancer type: LUNG: PAM dist: 13: indel length: 0: CRISPR gRNA ID: GF-CCELg9-157: [crRNA sequence]:
crRNA sequence: CACCACGGGAATGCTGGCGATGG (SEQ ID NO: 1342):
SpgRNA: attctaatacgactcactataggCACCACGGGAATGCTGGCGAgttttagagctagaaatagcaagttaaaataaggctagtccgt
tatcaacttgaaaaagtggcaccgagtcggtgc (SEQ ID NO: 1343): [Target gene information]: Gene ID: 23152:
Symbol: CIC: Ensembl Transcript ID: EN5T00000575354.2: GRCh: 37: Chr: 19: [Target cancer mutation
information]: mut start: 42797207: mut end: 42797207: mut class: Missense Mutation: mut type: SNP: ref
seq: G: mut seq: T: mut aa: p.G1190V: mutation info source: CCLE: ref target(-10 +10):
ATTCCCGTGGGGTCCTTTGAG (SEQ ID NO: 1336): mut target(-10 +10):
ATTCCCGTGGTGTCCTTTGAG (SEQ ID NO: 1337): [Model Cell line information]: cell: NCIH1573:
cancer type: LUNG: PAM dist: 19: indel length: 0: CRISPR gRNA ID: GF-CCELg9-158: [crRNA sequence]:
crRNA sequence: ACCTGCCTCAAAGGACACCACGG (SEQ ID NO: 1344):
SpgRNA: attctaatacgactcactataggACCTGCCTCAAAGGACACCAgttttagagctagaaatagcaagttaaaataaggctagtccgtt
atcaacttgaaaaagtggcaccgagtcggtgc (SEQ ID NO: 1345): [Target gene information]: Gene ID: 23152:
Symbol: CIC: Ensembl Transcript ID: EN5T00000575354.2: GRCh: 37: Chr: 19: [Target cancer mutation
information]: mut start: 42797207: mut end: 42797207: mut class: Missense Mutation: mut type: SNP: ref
seq: G: mut seq: T: mut aa: p.G1190V: mutation info source: CCLE: ref target(-10 +10):
ATTCCCGTGGGGTCCTTTGAG (SEQ ID NO: 1336): mut target(-10 +10):
ATTCCCGTGGTGTCCTTTGAG (SEQ ID NO: 1337): [Model Cell line information]: cell: NCIH1573:
cancer type: LUNG: PAM dist: 4: indel length: 0: CRISPR gRNA ID: GF-CCELg9-159: [crRNA sequence]:
crRNA sequence: CCTGCCTCAAAGGACACCACGGG (SEQ ID NO: 1346):
SpgRNA: attctaatacgactcactataggCCTGCCTCAAAGGACACCACgttttagagctagaaatagcaagttaaaataaggctagtccgtt
atcaacttgaaaaagtggcaccgagtcggtgc (SEQ ID NO: 1347): [Target gene information]: Gene ID: 23152:
Symbol: CIC: Ensembl Transcript ID: EN5T00000575354.2: GRCh: 37: Chr: 19: [Target cancer mutation
information]: mut start: 42797207: mut end: 42797207: mut class: Missense Mutation: mut type: SNP: ref
seq: G: mut seq: T: mut aa: p.G1190V: mutation info source: CCLE: ref target(-10 +10):
ATTCCCGTGGGGTCCTTTGAG (SEQ ID NO: 1336): mut target(-10 +10):
ATTCCCGTGGTGTCCTTTGAG (SEQ ID NO: 1337): [Model Cell line information]: cell: NCIH1573:
cancer type: LUNG: PAM dist: 5: indel length: 0: CRISPR gRNA ID: GF-CCELg9-160: [crRNA sequence]:
crRNA sequence: GCATTGGCAAGCTTGGGCTCAGG (SEQ ID NO: 1348):
SpgRNA: attctaatacgactcactataggGCATTGGCAAGCTTGGGCTCgttttagagctagaaatagcaagttaaaataaggctagtccgtt
atcaacttgaaaaagtggcaccgagtcggtgc (SEQ ID NO: 1349): [Target gene information]: Gene ID: 1436: Symbol:
CSF1R: Ensembl Transcript ID: EN5T00000286301.3: GRCh: 37: Chr: 5: [Target cancer mutation
information]: mut start: 149452890: mut end: 149452890: mut class: Silent: mut type: SNP: ref seq: A: mut TABLE 7-continued Illustrative guide RNA sequences for polypeptides comprising Cas9 seq: G: mut aa: p.A352A: mutation info source: CCLE: ref target(-10 +10):
TGGTAGCATTAGCAAGCTTGG (SEQ ID NO: 1350): mut target(-10 +10):
TGGTAGCATTGGCAAGCTTGG (SEQ ID NO: 1351): [Model Cell line information]: cell: NCIH1975:
cancer type: LUNG: PAM dist: 15: indel length: 0: CRISPR gRNA ID: GF-CCELg9-161: [crRNA sequence] ;
crRNA sequence: TGTGTCCTTGGTGGTAGCATTGG (SEQ ID NO: 1352):
SpgRNA: attctaatacgactcactataggTGTGTCCTTGGTGGTAGCATgttttagagctagaaatagcaagttaaaataaggctagtccgtt
atcaacttgaaaaagtggcaccgagtcggtgc (SEQ ID NO: 1353): [Target gene information]: Gene ID: 1436: Symbol:
CSF1R: Ensembl Transcript ID: EN5T00000286301.3: GRCh: 37: Chr: 5: [Target cancer mutation
information]: mut start: 149452890: mut end: 149452890: mut class: Silent: mut type: SNP: ref seq: A: mut
seq: G: mut aa: p.A352A: mutation info source: CCLE: ref target(-10 +10):
TGGTAGCATTAGCAAGCTTGG (SEQ ID NO: 1350): mut target(-10 +10):
TGGTAGCATTGGCAAGCTTGG (SEQ ID NO: 1351): [Model Cell line information]: cell: NCIH1975:
cancer type: LUNG: PAM dist: -1: indel length: 0: CRISPR gRNA ID: GF-CCELg9-162: [crRNA sequence]:
crRNA sequence: GGTGGTAGCATTGGCAAGCTTGG (SEQ ID NO: 1354):
SpgRNA: attctaatacgactcactataggGGTGGTAGCATTGGCAAGCTTgttttagagctagaaatagcaagttaaaataaggctagtccgtt
atcaacttgaaaaagtggcaccgagtcggtgc (SEQ ID NO: 1355): [Target gene information]: Gene ID: 1436: Symbol:
CSF1R: Ensembl Transcript ID: EN5T00000286301.3: GRCh: 37: Chr: 5: [Target cancer mutation
information]: mut start: 149452890: mut end: 149452890: mut class: Silent: mut type: SNP: ref seq: A: mut
seq: G: mut aa: p.A352A: mutation info source: CCLE: ref target(-10 +10):
TGGTAGCATTAGCAAGCTTGG (SEQ ID NO: 1350): mut target(-10 +10):
TGGTAGCATTGGCAAGCTTGG (SEQ ID NO: 1351): [Model Cell line information]: cell: NCIH1975:
cancer type: LUNG: PAM dist: 8: indel length: 0: CRISPR gRNA ID: GF-CCELg9-163: [crRNA sequence]:
crRNA sequence: TGGCAAGCTTGGGCTCAGGCTGG (SEQ ID NO: 1356):
SpgRNA: attctaatacgactcactataggTGGCAAGCTTGGGCTCAGGCgttttagagctagaaatagcaagttaaaataaggctagtccgtt
atcaacttgaaaaagtggcaccgagtcggtgc (SEQ ID NO: 1357): [Target gene information]: Gene ID: 1436: Symbol:
CSF1R: Ensembl Transcript ID: EN5T00000286301.3: GRCh: 37: Chr: 5: [Target cancer mutation
information]: mut start: 149452890: mut end: 149452890: mut class: Silent: mut type: SNP: ref seq: A: mut
seq: G: mut aa: p.A352A: mutation info source: CCLE: ref target(-10 +10):
TGGTAGCATTAGCAAGCTTGG (SEQ ID NO: 1350): mut target(-10 +10):
TGGTAGCATTGGCAAGCTTGG (SEQ ID NO: 1351): [Model Cell line information]: cell: NCIH1975:
cancer type: LUNG: PAM dist: 19: indel length: 0: CRISPR gRNA ID: GF-CCELg9-164: [crRNA sequence]:
crRNA sequence: GTGGTAGCATTGGCAAGCTTGGG (SEQ ID NO: 1358):
SpgRNA: attctaatacgactcactataggGTGGTAGCATTGGCAAGCTTgttttagagctagaaatagcaagttaaaataaggctagtccgtt
atcaacttgaaaaagtggcaccgagtcggtgc (SEQ ID NO: 1359): [Target gene information]: Gene ID: 1436: Symbol:
CSF1R: Ensembl Transcript ID: EN5T00000286301.3: GRCh: 37: Chr: 5: [Target cancer mutation
information]: mut start: 149452890: mut end: 149452890: mut class: Silent: mut type: SNP: ref seq: A: mut
seq: G: mut aa: p.A352A: mutation info source: CCLE: ref target(-10 +10):
TGGTAGCATTAGCAAGCTTGG (SEQ ID NO: 1350): mut target(-10 +10):
TGGTAGCATTGGCAAGCTTGG (SEQ ID NO: 1351): [Model Cell line information]: cell: NCIH1975:
cancer type: LUNG: PAM dist: 9: indel length: 0: CRISPR gRNA ID: GF-CCELg9-165: [crRNA sequence]:
crRNA sequence: GCTTGCCAATGCTACCACCAAGG (SEQ ID NO: 1360):
SpgRNA: attctaatacgactcactataggGCTTGCCAATGCTACCACCAgttttagagctagaaatagcaagttaaaataaggctagtccgtt
atcaacttgaaaaagtggcaccgagtcggtgc (SEQ ID NO: 1361): [Target gene information]: Gene ID: 1436: Symbol:
CSF1R: Ensembl Transcript ID: ENST00000286301.3: GRCh: 37: Chr: 5: [Target cancer mutation
information]: mut start: 149452890: mut end: 149452890: mut class: Silent: mut type: SNP: ref seq: A: mut
seq: G: mut aa: p.A352A: mutation info source: CCLE: ref target(-10 +10):
TGGTAGCATTAGCAAGCTTGG (SEQ ID NO: 1350): mut target(-10 +10):
TGGTAGCATTGGCAAGCTTGG (SEQ ID NO: 1351): [Model Cell line information]: cell: NCIH1975:
cancer type: LUNG: PAM dist: 14: indel length: 0: CRISPR gRNA ID: GF-CCELg9-166: [crRNA sequence]:
crRNA sequence: CATCACCTCCTTGCCCCGTTCGG (SEQ ID NO: 1362):
SpgRNA: attctaatacgactcactataggCATCACCTCCTTGCCCCGTTgttttagagctagaaatagcaagttaaaataaggctagtccgtta
tcaacttgaaaaagtggcaccgagtcggtgc (SEQ ID NO: 1363): [Target gene information]: Gene ID: 1441: Symbol:
CSF3R: Ensembl Transcript ID: ENST00000373106.1: GRCh: 37: Chr: 1: [Target cancer mutation
information]: mut start: 36937837: mut end: 36937837: mut class: Splice Site: mut type: SNP: ref seq: A:
mut seq: G: mut aa: -: mutation info source: CCLE: ref target(-10 +10): TCACCTCCTTACCCCGTTCGG
(SEQ ID NO: 1364): mut target(-10 +10): TCACCTCCTTGCCCCGTTCGG (SEQ ID NO: 1365): [Model
Cell line information]: cell: NCIH661: cancer type: LUNG: PAM dist: 8: indel length: 0: CRISPR gRNA ID:
GF-CCELg9-167: [crRNA sequence]: crRNA sequence: GAGAACTACCGAACGGGGCAAGG (SEQ ID
NO: 1366):
SpgRNA: attctaatacgactcactataggGAGAACTACCGAACGGGGCAg agagctagaaatagcaagttaaaataaggctagtccgt
tatcaacttgaaaaagtggcaccgagtcggtgc (SEQ ID NO: 1367): [Target gene information]: Gene ID: 1441: Symbol:
CSF3R: Ensembl Transcript ID: ENST00000373106.1: GRCh: 37: Chr: 1: [Target cancer mutation
information]: mut start: 36937837: mut end: 36937837: mut class: Splice Site: mut type: SNP: ref seq: A:
mut seq: G: mut aa: -: mutation info source: CCLE: ref target(-10 +10): TCACCTCCTTACCCCGTTCGG
(SEQ ID NO: 1364): mut target(-10 +10): TCACCTCCTTGCCCCGTTCGG (SEQ ID NO: 1365): [Model
Cell line information]: cell: NCIH661: cancer type: LUNG: PAM dist: 2: indel length: 0: CRISPR gRNA ID:
GF-CCELg9-168: [crRNA sequence]: crRNA sequence: AACTACCGAACGGGGCAAGGAGG (SEQ ID
NO: 1368):
SpgRNA: attctaatacgactcactataggAACTACCGAACGGGGCAAGGgttttagagctagaaatagcaagttaaaataaggctagtccgt
tatcaacttgaaaaagtggcaccgagtcggtgc (SEQ ID NO: 1369): [Target gene information]: Gene ID: 1441: Symbol:
CSF3R: Ensembl Transcript ID: ENST00000373106.1: GRCh: 37: Chr: 1: [Target cancer mutation
information]: mut start: 36937837: mut end: 36937837: mut class: Splice Site: mut type: SNP: ref seq: A:
mut seq: G: mut aa: -: mutation info source: CCLE: ref target(-10 +10): TCACCTCCTTACCCCGTTCGG
(SEQ ID NO: 1364): mut target(-10 +10): TCACCTCCTTGCCCCGTTCGG (SEQ ID NO: 1365): [Model
Cell line information]: cell: NCIH661: cancer type: LUNG: PAM dist: 5: indel length: 0: CRISPR gRNA ID:
GF-CCELg9-169: [crRNA sequence]: crRNA sequence: CGGGGCAAGGAGGTGATGAGAGG (SEQ ID
NO: 1370):

TABLE 7-continued

Illustrative guide RNA sequences for polypeptides comprising Cas9

SpgRNA: attctaatacgactcactataggCGGGGCAAGGAGGTGATGAGgttttagagctagaaatagcaagttaaaataaggctagtccg
ttatcaacttgaaaaagtggcaccgagtcggtgc (SEQ ID NO: 1371): [Target gene information]: Gene ID: 1441:
Symbol: CSF3R: Ensembl Transcript ID: ENST00000373106.1: GRCh: 37: Chr: 1: [Target cancer mutation
information]: mut start: 36937837: mut end: 36937837: mut class: Splice Site: mut type: SNP: ref seq: A:
mut seq: G: mut aa: -: mutation info source: CCLE: ref target(-10 +10): TCACCTCCTTAcCCCGTTCGG
(SEQ ID NO: 1364): mut target(-10 +10): TCACCTCCTTGCCCCGTTCGG (SEQ ID NO: 1365): [Model
Cell line information]: cell: NCIH661: cancer type: LUNG: PAM dist: 15: indel length: 0: CRISPR gRNA
ID: GF-CCELg9-170: [crRNA sequence]: crRNA sequence: GCAAGGAGGTGATGAGAGGCTGG (SEQ
ID NO: 1372):
SpgRNA: attctaatacgactcactataggGCAAGGAGGTGATGAGAGGCgttttagagctagaaatagcaagttaaaataaggctagtccg
ttatcaacttgaaaaagtggcaccgagtcggtgc (SEQ ID NO: 1373): [Target gene information]: Gene ID: 1441:
Symbol: CSF3R: Ensembl Transcript ID: ENST00000373106.1: GRCh: 37: Chr: 1: [Target cancer mutation
information]: mut start: 36937837: mut end: 36937837: mut class: Splice Site: mut type: SNP: ref seq: A:
mut seq: G: mut aa: -: mutation info source: CCLE: ref target(-10 +10): TCACCTCCTTAcCCCGTTCGG
(SEQ ID NO: 1364): mut target(-10 +10): TCACCTCCTTGCCCCGTTCGG (SEQ ID NO: 1365): [Model
Cell line information]: cell: NCIH661: cancer type: LUNG: PAM dist: 19: indel length: 0: CRISPR gRNA
ID: GF-CCELg9-171: [crRNA sequence]: crRNA sequence: CAAGGAGGTGATGAGAGGCTGGG (SEQ
ID NO: 1374):
SpgRNA: attctaatacgactcactataggCAAGGAGGTGATGAGAGGCTgttttagagctagaaatagcaagttaaaataaggctagtccgt
tatcaacttgaaaaagtggcaccgagtcggtgc (SEQ ID NO: 1375): [Target gene information]: Gene ID: 1441: Symbol:
CSF3R: Ensembl Transcript ID: ENST00000373106.1: GRCh: 37: Chr: 1: [Target cancer mutation
information]: mut start: 36937837: mut end: 36937837: mut class: Splice Site: mut type: SNP: ref seq: A:
mut seq: G: mut aa: -: mutation info source: CCLE: ref target(-10 +10): TCACCTCCTTAcCCCGTTCGG
(SEQ ID NO: 1364): mut target(-10 +10): TCACCTCCTTGCCCCGTTCGG (SEQ ID NO: 1365): [Model
Cell line information]: cell: NCIH661: cancer type: LUNG: PAM dist: 20: indel length: 0: CRISPR gRNA
ID: GF-CCELg9-172: [crRNA sequence]: crRNA sequence: ACAAGAAGTAGAAATAATATTGG (SEQ ID
NO: 1376):
SpgRNA: attctaatacgactcactataggACAAGAAGTAGAAATAATATgttttagagctagaaatagcaagttaaaataaggctagtccgt
tatcaacttgaaaaagtggcaccgagtcggtgc (SEQ ID NO: 1377): [Target gene information]: Gene ID: 8452: Symbol:
CUL3: Ensembl Transcript ID: ENST00000264414.4: GRCh: 37: Chr: 2: [Target cancer mutation
information]: mut start: 225368517: mut end: 225368517: mut class: Missense Mutation: mut type: SNP: ref
seq: G: mut seq: A: mut aa: p.T410I: mutation info source: CCLE: ref target(-10 +10):
ATCCAATATTGTTTCTACTTC (SEQ ID NO: 273): mut target(-10 +10):
ATCCAATATTATTTCTACTTC (SEQ ID NO: 274): [Model Cell line information]: cell: NCIH460: cancer
type: LUNG: PAM dist: 6: indel length: 0: CRISPR gRNA ID: GF-CCELg9-173: [crRNA sequence]: crRNA
sequence: AATAATATTGGATAAAGCAATGG (SEQ ID NO: 1378):
SpgRNA: attctaatacgactcactataggAATAATATTGGATAAAGCAAgttttagagctagaaatagcaagttaaaataaggctagtccgt
tatcaacttgaaaaagtggcaccgagtcggtgc (SEQ ID NO:1379): [Target gene information]: Gene ID: 8452: Symbol:
CUL3: Ensembl Transcript ID: ENST00000264414.4: GRCh: 37: Chr: 2: [Target cancer mutation
information]: mut start: 225368517: mut end: 225368517: mut class: Missense Mutation: mut type: SNP: ref
seq: G: mut seq: A: mut aa: p.T410I: mutation info source: CCLE: ref target(-10 +10):
ATCCAATATTGTTTCTACTTC (SEQ ID NO: 273): mut target(-10 +10):
ATCCAATATTATTTCTACTTC (SEQ ID NO: 274): [Model Cell line information]: cell: NCIH460: cancer
type: LUNG: PAM dist: 18: indel length: 0: CRISPR gRNA ID: GF-CCELg9-174: [crRNA sequence]:
crRNA sequence: AAATCTTGTACATACCTTCAAGG (SEQ ID NO: 1380):
SpgRNA: attctaatacgactcactataggAAATCTTGTACATACCTTCAgttttagagctagaaatagcaagttaaaataaggctagtccgtt
atcaacttgaaaaagtggcaccgagtcggtgc (SEQ ID NO: 1381): [Target gene information]: Gene ID: 22894:
Symbol: DI53: Ensembl Transcript ID: EN5T00000377767.4: GRCh: 37: Chr: 13: [Target cancer mutation
information]: mut start: 73350155: mut end: 73350155: mut class: Missense Mutation: mut type: SNP: ref
seq: C: mut seq: A: mut aa: p.G244C: mutation info source: CCLE: ref target(-10 +10):
AGGTATGTACCAGATTTTATG (SEQ ID NO: 1382): mut target(-10 +10):
AGGTATGTACAAGATTTTATG (SEQ ID NO: 1383): [Model Cell line information]: cell: NCIH1573:
cancer type: LUNG: PAM dist: 14: indel length: 0: CRISPR gRNA ID: GF-CCELg9-175: [crRNA sequence]:
crRNA sequence: TCACTTGAGCAGCATGAGCCAGG (SEQ ID NO: 1384):
SpgRNA: attctaatacgactcactataggTCACTTGAGCAGCATGAGCCgttttagagctagaaatagcaagttaaaataaggctagtccgtt
atcaacttgaaaaagtggcaccgagtcggtgc (SEQ ID NO: 1385): [Target gene information]: Gene ID: 84444:
Symbol: DOT1L: Ensembl Transcript ID: EN5T00000398665.3: GRCh: 37: Chr: 19: [Target cancer mutation
information]: mut start: 2216482: mut end: 2216482: mut class: Missense Mutation: mut type: SNP: ref seq:
C: mut seq: A: mut aa: p.P709Q: mutation info source: CCLE: ref target(-10 +10):
AGCATGAGCCCGGAGCTCTCC (SEQ ID NO: 1386): mut target(-10 +10):
AGCATGAGCCAGGAGCTCTCC (SEQ ID NO: 1387): [Model Cell line information]: cell: NCIH661:
cancer type: LUNG: PAM dist: 0: indel length: 0: CRISPR gRNA ID: GF-CCELg9-176: [crRNA sequence]:
crRNA sequence: AGCCAGGAGCTCTCCATGAACGG (SEQ ID NO: 1388):
SpgRNA: attctaatacgactcactataggAGCCAGGAGCTCTCCATGAAg agagctagaaatagcaagttaaaataaggctagtccgtt
atcaacttgaaaaagtggcaccgagtcggtgc (SEQ ID NO: 1389): [Target gene information]: Gene ID: 84444:
Symbol: DOT1L: Ensembl Transcript ID: ENST00000398665.3: GRCh: 37: Chr: 19: [Target cancer mutation
information]: mut start: 2216482: mut end: 2216482: mut class: Missense Mutation: mut type: SNP: ref seq:
C: mut seq: A: mut aa: p.P709Q: mutation info source: CCLE: ref target(-10 +10):
AGCATGAGCCCGGAGCTCTCC (SEQ ID NO: 1386): mut target(-10 +10):
AGCATGAGCCAGGAGCTCTCC (SEQ ID NO: 1387): [Model Cell line information]: cell: NCIH661:
cancer type: LUNG: PAM dist: 16: indel length: 0: CRISPR gRNA ID: GF-CCELg9-177: [crRNA sequence]:
crRNA sequence: TGGCTCATGCTGCTCAAGTGAGG (SEQ ID NO: 1390):
SpgRNA: attctaatacgactcactataggTGGCTCATGCTGCTCAAGTGgttttagagctagaaatagcaagttaaaataaggctagtccgtt
atcaacttgaaaaagtggcaccgagtcggtgc (SEQ ID NO: 1391): [Target gene information]: Gene ID: 84444:
Symbol: DOT1L: Ensembl Transcript ID: EN5T00000398665.3: GRCh: 37: Chr: 19: [Target cancer mutation
information]: mut start: 2216482: mut end: 2216482: mut class: Missense Mutation: mut type: SNP: ref seq:
C: mut seq: A: mut aa: p.P709Q: mutation info source: CCLE: ref target(-10 +10):
AGCATGAGCCCGGAGCTCTCC (SEQ ID NO: 1386): mut target(-10 +10):

TABLE 7-continued

Illustrative guide RNA sequences for polypeptides comprising Cas9

AGCATGAGCCAGGAGCTCTCC (SEQ ID NO: 1387): [Model Cell line information]: cell: NCIH661:
cancer type: LUNG: PAM dist: 20: indel length: 0: CRISPR gRNA ID: GF-CCELg9-178: [crRNA sequence]:
crRNA sequence: GGCCGTTCATGGAGAGCTCCTGG (SEQ ID NO: 1392):
SpgRNA: attctaatacgactcactataggGGCCGTTCATGGAGAGCTCCgttttagagctagaaatagcaagttaaaataaggctagtccgtt
atcaacttgaaaaagtggcaccgagtcggtgc (SEQ ID NO: 1393): [Target gene information]: Gene ID: 84444:
Symbol: DOT1L: Ensembl Transcript ID: EN5T00000398665.3: GRCh: 37: Chr: 19: [Target cancer mutation
information]: mut start: 2216482: mut end: 2216482: mut class: Missense Mutation: mut type: SNP: ref seq:
C: mut seq: A: mut aa: p.P709Q: mutation info source: CCLE: ref target(-10 +10):
AGCATGAGCCCGGAGCTCTCC (SEQ ID NO: 1386): mut target(-10 +10):
AGCATGAGCCAGGAGCTCTCC (SEQ ID NO: 1387): [Model Cell line information]: cell: NCIH661:
cancer type: LUNG: PAM dist: 0: indel length: 0: CRISPR gRNA ID: GF-CCELg9-179: [crRNA sequence]:
crRNA sequence: GGCGGCGTCGAAGCCGGGGCTGG (SEQ ID NO: 1394):
SpgRNA: attctaatacgactcactataggGGCGGCGTCGAAGCCGGGCgttttagagctagaaatagcaagttaaaataaggctagtccgt
tatcaacttgaaaaagtggcaccgagtcggtgc (SEQ ID NO:1395): [Target gene information]: Gene ID: 1871: Symbol:
E2F3: Ensembl Transcript ID: EN5T00000346618.3: GRCh: 37: Chr: 6: [Target cancer mutation
information]: mut start: 20402597: mut end: 20402597: mut class: Missense Mutation: mut type: SNP: ref
seq: C: mut seq: A: mut aa: p.A45D: mutation info source: CCLE: ref target(-10 +10):
CCCGGCTTCGCCGCCGCCGCC (SEQ ID NO: 1396): mut target(-10 +10):
CCCGGCTTCGACGCCGCCGCC (SEQ ID NO: 1397): [Model Cell line information]: cell: NCIH1563:
cancer type: LUNG: PAM dist: 13: indel length: 0: CRISPR gRNA ID: GF-CCELg9-180: [crRNA sequence]:
crRNA sequence: GGCGGCGGCGGCGTCGAAGCCGG (SEQ ID NO: 1398):
SpgRNA: attctaatacgactcactataggGGCGGCGGCGGCGTCGAAGCgttttagagctagaaatagcaagttaaaataaggctagtccgt
tatcaacttgaaaaagtggcaccgagtcggtgc (SEQ ID NO: 1399): [Target gene information]: Gene ID: 1871: Symbol:
E2F3: Ensembl Transcript ID: ENST00000346618.3: GRCh: 37: Chr: 6: [Target cancer mutation
information]: mut start: 20402597: mut end: 20402597: mut class: Missense Mutation: mut type: SNP: ref
seq: C: mut seq: A: mut aa: p.A45D: mutation info source: CCLE: ref target(-10 +10):
CCCGGCTTCGCCGCCGCCGCC (SEQ ID NO: 1396): mut target(-10 +10):
CCCGGCTTCGACGCCGCCGCC (SEQ ID NO: 1397): [Model Cell line information]: cell: NCIH1563:
cancer type: LUNG: PAM dist: 7: indel length: 0: CRISPR gRNA ID: GF-CCELg9-181: [crRNA sequence]:
crRNA sequence: GCGGCGGCGGCGTCGAAGCCGGG (SEQ ID NO: 1400):
SpgRNA: attctaatacgactcactataggGCGGCGGCGGCGTCGAAGCCGgttttagagctagaaatagcaagttaaaataaggctagtccgt
tatcaacttgaaaaagtggcaccgagtcggtgc (SEQ ID NO: 1401): [Target gene information]: Gene ID: 1871: Symbol:
E2F3: Ensembl Transcript ID: EN5T00000346618.3: GRCh: 37: Chr: 6: [Target cancer mutation
information]: mut start: 20402597: mut end: 20402597: mut class: Missense Mutation: mut type: SNP: ref
seq: C: mut seq: A: mut aa: p.A45D: mutation info source: CCLE: ref target(-10 +10):
CCCGGCTTCGCCGCCGCCGCC (SEQ ID NO: 1396): mut target(-10 +10):
CCCGGCTTCGACGCCGCCGCC (SEQ ID NO: 1397): [Model Cell line information]: cell: NCIH1563:
cancer type: LUNG: PAM dist: 8: indel length: 0: CRISPR gRNA ID: GF-CCELg9-182: [crRNA sequence]:
crRNA sequence: CGGCGGCGGCGTCGAAGCCGGGG (SEQ ID NO: 1402):
SpgRNA: attctaatacgactcactataggCGGCGGCGGCGTCGAAGCCGGGgttttagagctagaaatagcaagttaaaataaggctagtccgt
tatcaacttgaaaaagtggcaccgagtcggtgc (SEQ ID NO: 1403): [Target gene information]: Gene ID: 1871: Symbol:
E2F3: Ensembl Transcript ID: EN5T00000346618.3: GRCh: 37: Chr: 6: [Target cancer mutation
information]: mut start: 20402597: mut end: 20402597: mut class: Missense Mutation: mut type: SNP: ref
seq: C: mut seq: A: mut aa: p.A45D: mutation info source: CCLE: ref target(-10 +10):
CCCGGCTTCGCCGCCGCCGCC (SEQ ID NO: 1396): mut target(-10 +10):
CCCGGCTTCGACGCCGCCGCC (SEQ ID NO: 1397): [Model Cell line information]: cell: NCIH1563:
cancer type: LUNG: PAM dist: 9: indel length: 0: CRISPR gRNA ID: GF-CCELg9-183: [crRNA sequence]:
crRNA sequence: ATCATGCAGCTCATGCCCTTCGG (SEQ ID NO: 1404):
SpgRNA: attctaatacgactcactataggATCATGCAGCTCATGCCCTTgttttagagctagaaatagcaagttaaaataaggctagtccgtt
atcaacttgaaaaagtggcaccgagtcggtgc (SEQ ID NO: 1405): [Target gene information]: Gene ID: 1956: Symbol:
EGFR: Ensembl Transcript ID: EN5T00000275493.2: GRCh: 37: Chr: 7: [Target cancer mutation
information]: mut start: 55249071: mut end: 55249071: mut class: Missense Mutation: mut type: SNP: ref
seq: C: mut seq: T: mut aa: p.T790M: mutation info source: CCLE: ref target(-10 +10):
CAGCTCATCACGCAGCTCATG (SEQ ID NO: 1406): mut target(-10 +10):
CAGCTCATCATGCAGCTCATG (SEQ ID NO: 1407): [Model Cell line information]: cell: NCIH1975:
cancer type: LUNG: PAM dist: 16: indel length: 0: CRISPR gRNA ID: GF-CCELg9-184: [crRNA sequence]
crRNA sequence: CATGATGAGCTGCACGGTGGAGG (SEQ ID NO: 1408):
SpgRNA: attctaatacgactcactataggCATGATGAGCTGCACGGTGGgttttagagctagaaatagcaagttaaaataaggctagtccgtt
atcaacttgaaaaagtggcaccgagtcggtgc (SEQ ID NO: 1409): [Target gene information]: Gene ID: 1956: Symbol:
EGFR: Ensembl Transcript ID: EN5T00000275493.2: GRCh: 37: Chr: 7: [Target cancer mutation
information]: mut start: 55249071: mut end: 55249071: mut class: Missense Mutation: mut type: SNP: ref
seq: C: mut seq: T: mut aa: p.T790M: mutation info source: CCLE: ref target(-10 +10):
CAGCTCATCACGCAGCTCATG (SEQ ID NO: 1406): mut target(-10 +10):
CAGCTCATCATGCAGCTCATG (SEQ ID NO: 1407): [Model Cell line information]: cell: NCIH1975:
cancer type: LUNG: PAM dist: 19: indel length: 0: CRISPR gRNA ID: GF-CCELg9-185: [crRNA sequence]:
crRNA sequence: CTGCATGATGAGCTGCACGGTGG (SEQ ID NO: 1410):
SpgRNA: attctaatacgactcactataggCTGCATGATGAGCTGCACGGgttttagagctagaaatagcaagttaaaataaggctagtccgtt
atcaacttgaaaaagtggcaccgagtcggtgc (SEQ ID NO: 1411): [Target gene information]: Gene ID: 1956: Symbol:
EGFR: Ensembl Transcript ID: EN5T00000275493.2: GRCh: 37: Chr: 7: [Target cancer mutation
information]: mut start: 55249071: mut end: 55249071: mut class: Missense Mutation: mut type: SNP: ref
seq: C: mut seq: T: mut aa: p.T790M: mutation info source: CCLE: ref target(-10 +10):
CAGCTCATCACGCAGCTCATG (SEQ ID NO: 1406): mut target(-10 +10):
CAGCTCATCATGCAGCTCATG (SEQ ID NO: 1407): [Model Cell line information]: cell: NCIH1975:
cancer type: LUNG: PAM dist: 16: indel length: 0: CRISPR gRNA ID: GF-CCELg9-186: [crRNA sequence]:
crRNA sequence: GAGCTGCATGATGAGCTGCACGG (SEQ ID NO: 1412):
SpgRNA: attctaatacgactcactataggGAGCTGCATGATGAGCTGCAgttttagagctagaaatagcaagttaaaataaggctagtccgtt
atcaacttgaaaaagtggcaccgagtcggtgc (SEQ ID NO: 1413): [Target gene information]: Gene ID: 1956: Symbol:
EGFR: Ensembl Transcript ID: EN5T00000275493.2: GRCh: 37: Chr: 7: [Target cancer mutation TABLE 7-continued Illustrative guide RNA sequences for polypeptides comprising Cas9 information]: mut start: 55249071: mut end: 55249071: mut class: Missense Mutation: mut type: SNP: ref
seq: C: mut seq: T: mut aa: p.T790M: mutation info source: CCLE: ref target(-10 +10):
CAGCTCATCACGCAGCTCATG (SEQ ID NO: 1406): mut target(-10 +10):
CAGCTCATCATGCAGCTCATG (SEQ ID NO: 1407): [Model Cell line information]: cell: NCIH1975:
cancer type: LUNG: PAM dist: 13: indel length: 0: CRISPR gRNA ID: GF-CCELg9-187: [crRNA sequence]
crRNA sequence: TTTTGGGCGGGCCAAACTGCTGG (SEQ ID NO: 1414):
SpgRNA: attctaatacgactcactataggTTTTGGGCGGGCCAAACTGCTGagagctagaaatagcaagttaaaataaggctagtccgtt
atcaacttgaaaaagtggcaccgagtcggtgc (SEQ ID NO: 1415): [Target gene information]: Gene ID: 1956: Symbol:
EGFR: Ensembl Transcript ID: ENST00000275493.2: GRCh: 37: Chr: 7: [Target cancer mutation
information]: mut start: 55259515: mut end: 55259515: mut class: Missense Mutation: mut type: SNP: ref
seq: T: mut seq: G: mut aa: p.L858R: mutation info source: CCLE: ref target(-10 +10):
GATTTTGGGCTGGCCAAACTG (SEQ ID NO: 289): mut target(-10 +10):
GATTTTGGGCGGGCCAAACTG (SEQ ID NO: 290): [Model Cell line information]: cell: NCIH1975:
cancer type: LUNG: PAM dist: 12: indel length: 0: CRISPR gRNA ID: GF-CCELg9-188: [crRNA sequence]:
crRNA sequence: TCAAGATCACAGATTTTGGGCGG (SEQ ID NO: 1416):
SpgRNA: attctaatacgactcactataggTCAAGATCACAGATTTTGGGgttttagagctagaaatagcaagttaaaataaggctagtccgtt
atcaacttgaaaaagtggcaccgagtcggtgc (SEQ ID NO: 1417): [Target gene information]: Gene ID: 1956: Symbol:
EGFR: Ensembl Transcript ID: EN5T00000275493.2: GRCh: 37: Chr: 7: [Target cancer mutation
information]: mut start: 55259515: mut end: 55259515: mut class: Missense Mutation: mut type: SNP: ref
seq: T: mut seq: G: mut aa: p.L858R: mutation info source: CCLE: ref target(-10 +10):
GATTTTGGGCTGGCCAAACTG (SEQ ID NO: 289): mut target(-10 +10):
GATTTTGGGCGGGCCAAACTG (SEQ ID NO: 290): [Model Cell line information]: cell: NCIH1975:
cancer type: LUNG: PAM dist: -1: indel length: 0: CRISPR gRNA ID: GF-CCELg9-189: [crRNA sequence]:
crRNA sequence: GCGGGCCAAACTGCTGGGTGCGG (SEQ ID NO: 1418):
SpgRNA: attctaatacgactcactataggGCGGGCCAAACTGCTGGGTGgttttagagctagaaatagcaagttaaaataaggctagtccgt
tatcaacttgaaaaagtggcaccgagtcggtgc (SEQ ID NO: 1419): [Target gene information]: Gene ID: 1956: Symbol:
EGFR: Ensembl Transcript ID: EN5T00000275493.2: GRCh: 37: Chr: 7: [Target cancer mutation
information]: mut start: 55259515: mut end: 55259515: mut class: Missense Mutation: mut type: SNP: ref
seq: T: mut seq: G: mut aa: p.L858R: mutation info source: CCLE: ref target(-10 +10):
GATTTTGGGCTGGCCAAACTG (SEQ ID NO: 289): mut target(-10 +10):
GATTTTGGGCGGGCCAAACTG (SEQ ID NO: 290): [Model Cell line information]: cell: NCIH1975:
cancer type: LUNG: PAM dist: 18: indel length: 0: CRISPR gRNA ID: GF-CCELg9-190: [crRNA sequence]:
crRNA sequence: CAAGATCACAGATTTTGGGCGGG (SEQ ID NO: 1420):
SpgRNA: attctaatacgactcactataggCAAGATCACAGATTTTGGGCgttttagagctagaaatagcaagttaaaataaggctagtccgtt
atcaacttgaaaaagtggcaccgagtcggtgc (SEQ ID NO: 1421): [Target gene information]: Gene ID: 1956: Symbol:
EGFR: Ensembl Transcript ID: EN5T00000275493.2: GRCh: 37: Chr: 7: [Target cancer mutation
information]: mut start: 55259515: mut end: 55259515: mut class: Missense Mutation: mut type: SNP: ref
seq: T: mut seq: G: mut aa: p.L858R: mutation info source: CCLE: ref target(-10 +10):
GATTTTGGGCTGGCCAAACTG (SEQ ID NO: 289): mut target(-10 +10):
GATTTTGGGCGGGCCAAACTG (SEQ ID NO: 290): [Model Cell line information]: cell: NCIH1975:
cancer type: LUNG: PAM dist: 0: indel length: 0: CRISPR gRNA ID: GF-CCELg9-191: [crRNA sequence]:
crRNA sequence: TTTGGGCGGGCCAAACTGCTGGG (SEQ ID NO: 1422):
SpgRNA: attctaatacgactcactataggTTTGGGCGGGCCAAACTGCTgttttagagctagaaatagcaagttaaaataaggctagtccgtt
atcaacttgaaaaagtggcaccgagtcggtgc (SEQ ID NO: 1423): [Target gene information]: Gene ID: 1956: Symbol:
EGFR: Ensembl Transcript ID: EN5T00000275493.2: GRCh: 37: Chr: 7: [Target cancer mutation
information]: mut start: 55259515: mut end: 55259515: mut class: Missense Mutation: mut type: SNP: ref
seq: T: mut seq: G: mut aa: p.L858R: mutation info source: CCLE: ref target(-10 +10):
GATTTTGGGCTGGCCAAACTG (SEQ ID NO: 289): mut target(-10 +10):
GATTTTGGGCGGGCCAAACTG (SEQ ID NO: 290): [Model Cell line information]: cell: NCIH1975:
cancer type: LUNG: PAM dist: 13: indel length: 0: CRISPR gRNA ID: GF-CCELg9-192: [crRNA sequence]:
crRNA sequence: CGGAGATGTTTTGATAGCGACGG (SEQ ID NO: 1424):
SpgRNA: attctaatacgactcactataggCGGAGATGTTTTGATAGCGACgttttagagctagaaatagcaagttaaaataaggctagtccgtt
atcaacttgaaaaagtggcaccgagtcggtgc (SEQ ID NO: 1425): [Target gene information]: Gene ID: 1956: Symbol:
EGFR: Ensembl Transcript ID: EN5T00000275493.2: GRCh: 37: Chr: 7: [Target cancer mutation
information]: mut start: 55242465: mut end: 55242479: mut class: In Frame Del: mut type: DEL: ref seq:
GGAATTAAGAGAAGC (SEQ ID NO: 86): mut seq: -: mut aa: p.ELREA746del ("ELREA" disclosed as
SEQ ID NO: 87): mutation info source: CCLE: ref target(-10 +10):
TCGCTATCAAGGAATTAAGAGAAGCAACATCTCCG (SEQ ID NO: 91): mut target(-10 +10):
TCGCTATCAA---------------AACATCTCCG (SEQ ID NO: 94): [Model Cell line information]: cell:
NCIH1650: cancer type: LUNG: PAM dist: 11: indel length: 15: CRISPR gRNA ID: GF-CCELg9-193:
[crRNA sequence]: crRNA sequence: GGAGATGTTTTGATAGCGACGGG (SEQ ID NO: 1426):
SpgRNA: attctaatacgactcactataggGGAGATGTTTTGATAGCGACgttttagagctagaaatagcaagttaaaataaggctagtccgtt
atcaacttgaaaaagtggcaccgagtcggtgc (SEQ ID NO: 1427): [Target gene information]: Gene ID: 1956: Symbol:
EGFR: Ensembl Transcript ID: EN5T00000275493.2: GRCh: 37: Chr: 7: [Target cancer mutation
information]: mut start: 55242465: mut end: 55242479: mut class: In Frame Del: mut type: DEL: ref seq:
GGAATTAAGAGAAGC (SEQ ID NO: 86): mut seq: -: mut aa: p.ELREA746del ("ELREA" disclosed as
SEQ ID NO: 87): mutation info source: CCLE: ref target(-10 +10):
TCGCTATCAAGGAATTAAGAGAAGCAACATCTCCG (SEQ ID NO: 91): mut target(-10 +10):
TCGCTATCAA---------------AACATCTCCG (SEQ ID NO: 94): [Model Cell line information]: cell:
NCIH1650: cancer type: LUNG: PAM dist: 12: indel length: 15: CRISPR gRNA ID: GF-CCELg9-194:
[crRNA sequence]: crRNA sequence: GACATCTCCGAAAGCCAACAAGG (SEQ ID NO: 1428):
SpgRNA: attctaatacgactcactataggGACATCTCCGAAAGCCAACAgttttagagctagaaatagcaagttaaaataaggctagtccgt
tatcaacttgaaaaagtggcaccgagtcggtgc (SEQ ID NO: 1429): [Target gene information]: Gene ID: 1956: Symbol:
EGFR: Ensembl Transcript ID: ENST00000275493.2: GRCh: 37: Chr: 7: [Target cancer mutation
information]: mut start: 55242466: mut end: 55242480: mut class: In Frame Del: mut type: DEL: ref seq:
GAATTAAGAGAAGCA (SEQ ID NO: 100): mut seq: -: mut aa: p.ELREA746del ("ELREA" disclosed as
SEQ ID NO: 87): mutation info source: CCLE: ref target(-10 +10):
CGCTATCAAGGAATTAAGAGAAGCAACATCTCCGA (SEQ ID NO: 104): mut target(-10 +10):

TABLE 7-continued

Illustrative guide RNA sequences for polypeptides comprising Cas9

CGCTATCAAGA----------------CATCTCCGA (SEQ ID NO: 107): [Model Cell line information]: cell:
HCC827: cancer type: LUNG: PAM dist: 20: indel length: 15: CRISPR gRNA ID: GF-CCELg9-195:
[crRNA sequence]: crRNA sequence: CGGAGATGTCTTGATAGCGACGG (SEQ ID NO: 101):
SpgRNA: attctaatacgactcactataggCGGAGATGTCTTGATAGCGAgttttagagctagaaatagcaagttaaaataaggctagtccgtt
atcaacttgaaaaagtggcaccgagtcggtgc (SEQ ID NO: 109): [Target gene information]: Gene ID: 1956: Symbol:
EGFR: Ensembl Transcript ID: EN5T00000275493.2: GRCh: 37: Chr: 7: [Target cancer mutation
information]: mut start: 55242466: mut end: 55242480: mut class: In Frame Del: mut type: DEL: ref seq:
GAATTAAGAGAAGCA (SEQ ID NO: 100): mut seq: -: mut aa: p.ELREA746del ("ELREA" disclosed as
SEQ ID NO: 87): mutation info source: CCLE: ref target(-10 +10):
CGCTATCAAGGAATTAAGAGAAGCAACATCTCCGA (SEQ ID NO: 104): mut target(-10 +10):
CGCTATCAAGA----------------CATCTCCGA (SEQ ID NO: 107): [Model Cell line information]: cell:
HCC827: cancer type: LUNG: PAM dist: 12: indel length: 15: CRISPR gRNA ID: GF-CCELg9-196:
[crRNA sequence]: crRNA sequence: GGAGATGTCTTGATAGCGACGGG (SEQ ID NO: 1430):
SpgRNA: attctaatacgactcactataggGGAGATGTCTTGATAGCGACgttttagagctagaaatagcaagttaaaataaggctagtccgtt
atcaacttgaaaaagtggcaccgagtcggtgc (SEQ ID NO: 1431): [Target gene information]: Gene ID: 1956: Symbol:
EGFR: Ensembl Transcript ID: EN5T00000275493.2: GRCh: 37: Chr: 7: [Target cancer mutation
information]: mut start: 55242466: mut end: 55242480: mut class: In Frame Del: mut type: DEL: ref seq:
GAATTAAGAGAAGCA (SEQ ID NO: 100): mut seq: -: mut aa: p.ELREA746del ("ELREA" disclosed as
SEQ ID NO: 87): mutation info source: CCLE: ref target(-10 +10):
CGCTATCAAGGAATTAAGAGAAGCAACATCTCCGA (SEQ ID NO: 104): mut target(-10 +10):
CGCTATCAAGA----------------CATCTCCGA (SEQ ID NO: 107): [Model Cell line information]: cell:
HCC827: cancer type: LUNG: PAM dist: 13: indel length: 15: CRISPR gRNA ID: GF-CCELg9-197:
[crRNA sequence]: crRNA sequence: GACATCTCCGAAAGCCAACAAGG (SEQ ID NO: 1428):
SpgRNA: attctaatacgactcactataggGACATCTCCGAAAGCCAACAgttttagagctagaaatagcaagttaaaataaggctagtccgt
tatcaacttgaaaaagtggcaccgagtcggtgc (SEQ ID NO: 1429): [Target gene information]: Gene ID: 1956: Symbol:
EGFR: Ensembl Transcript ID: EN5T00000275493.2: GRCh: 37: Chr: 7: [Target cancer mutation
information]: mut start: 55242466: mut end: 55242480: mut class: In Frame Del: mut type: DEL: ref seq:
GAATTAAGAGAAGCA (SEQ ID NO: 100): mut seq: -: mut aa: p.ELREA746del ("ELREA" disclosed as
SEQ ID NO: 87): mutation info source: CCLE: ref target(-10 +10):
CGCTATCAAGGAATTAAGAGAAGCAACATCTCCGA (SEQ ID NO: 104): mut target(-10 +10):
CGCTATCAAGA----------------CATCTCCGA (SEQ ID NO: 107): [Model Cell line information]: cell:
HCC827GR5: cancer type: LUNG: PAM dist: 20: indel length: 15: CRISPR gRNA ID: GF-CCELg9-198:
[crRNA sequence]: crRNA sequence: CGGAGATGTCTTGATAGCGACGG (SEQ ID NO: 101):
SpgRNA: attctaatacgactcactataggCGGAGATGTCTTGATAGCGAgttttagagctagaaatagcaagttaaaataaggctagtccgtt
atcaacttgaaaaagtggcaccgagtcggtgc (SEQ ID NO: 109): [Target gene information]: Gene ID: 1956: Symbol:
EGFR: Ensembl Transcript ID: ENST00000275493.2: GRCh: 37: Chr: 7: [Target cancer mutation
information]: mut start: 55242466: mut end: 55242480: mut class: In Frame Del: mut type: DEL: ref seq:
GAATTAAGAGAAGCA (SEQ ID NO: 100): mut seq: -: mut aa: p.ELREA746del ("ELREA" disclosed as
SEQ ID NO: 87): mutation info source: CCLE: ref target(-10 +10):
CGCTATCAAGGAATTAAGAGAAGCAACATCTCCGA (SEQ ID NO: 104): mut target(-10 +10):
CGCTATCAAG----------------ACATCTCCGA (SEQ ID NO: 107): [Model Cell line information]: cell:
HCC827GR5: cancer type: LUNG: PAM dist: 12: indel length: 15: CRISPR gRNA ID: GF-CCELg9-199:
[crRNA sequence]: crRNA sequence: GGAGATGTCTTGATAGCGACGGG (SEQ ID NO: 1430):
SpgRNA: attctaatacgactcactataggGGAGATGTCTTGATAGCGACgttttagagctagaaatagcaagttaaaataaggctagtccgtt
atcaacttgaaaaagtggcaccgagtcggtgc (SEQ ID NO: 1431): [Target gene information]: Gene ID: 1956: Symbol:
EGFR: Ensembl Transcript ID: EN5T00000275493.2: GRCh: 37: Chr: 7: [Target cancer mutation
information]: mut start: 55242466: mut end: 55242480: mut class: In Frame Del: mut type: DEL: ref seq:
GAATTAAGAGAAGCA (SEQ ID NO: 100): mut seq: -: mut aa: p.ELREA746del ("ELREA" disclosed as
SEQ ID NO: 87): mutation info source: CCLE: ref target(-10 +10):
CGCTATCAAGGAATTAAGAGAAGCAACATCTCCGA (SEQ ID NO: 104): mut target(-10 +10):
CGCTATCAAG----------------ACATCTCCGA (SEQ ID NO: 107): [Model Cell line information]: cell:
HCC827GR5: cancer type: LUNG: PAM dist: 13: indel length: 15: CRISPR gRNA ID: GF-CCELg9-200:
[crRNA sequence]: crRNA sequence: TCTTTACAGTGCACTTCAAAAGG (SEQ ID NO: 1432):
SpgRNA: attctaatacgactcactataggTCTTTACAGTGCACTTCAAAgttttagagctagaaatagcaagttaaaataaggctagtccgtt
atcaacttgaaaaagtggcaccgagtcggtgc (SEQ ID NO: 1433): [Target gene information]: Gene ID: 4072: Symbol:
EPCAM: Ensembl Transcript ID: EN5T00000263735.4: GRCh: 37: Chr: 2: [Target cancer mutation
information]: mut start: 47604162: mut end: 47604162: mut class: Silent: mut type: SNP: ref seq: G: mut
seq: A: mut aa: p.Q167Q: mutation info source: CCLE: ref target(-10 +10):
GTGCACTTCAGAAGGAGATCA (SEQ ID NO: 307): mut target(-10 +10):
GTGCACTTCAAAAGGAGATCA (SEQ ID NO: 308): [Model Cell line information]: cell: NCIH1975:
cancer type: LUNG: PAM dist: 2: indel length: 0: CRISPR gRNA ID: GF-CCELg9-201: [crRNA sequence]:
crRNA sequence: CGAACTTTCGCGTGTCCTGGAGG (SEQ ID NO: 1434):
SpgRNA: attctaatacgactcactataggCGAACTTTCGCGTGTCCTGGgintagagctagaaatagcaagttaaaataaggctagtccgtt
atcaacttgaaaaagtggcaccgagtcggtgc (SEQ ID NO: 143 5): [Target gene information]: Gene ID: 2042: Symbol:
EPHA3: Ensembl Transcript ID: EN5T00000336596.2: GRCh: 37: Chr: 3: [Target cancer mutation
information]: mut start: 89480460: mut end: 89480460: mut class: Missense Mutation: mut type: SNP: ref
seq: G: mut seq: A: mut aa: p.G766E: mutation info source: CCLE: ref target(-10 +10):
TCTGATTTCGGACTTTCGCGT (SEQ ID NO: 319): mut target(-10 +10):
TCTGATTTCGAACTTTCGCGT (SEQ ID NO: 320): [Model Cell line information]: cell: NCIH2126:
cancer type: LUNG: PAM dist: 18: indel length: 0: CRISPR gRNA ID: GF-CCELg9-202: [crRNA sequence]
: crRNA sequence: TTTCGAACTTTCGCGTGTCCTGG (SEQ ID NO: 1436):
SpgRNA: attctaatacgactcactataggTTTCGAACTTTCGCGTGTCCgttttagagctagaaatagcaagttaaaataaggctagtccgtta
tcaacttgaaaaagtggcaccgagtcggtgc (SEQ ID NO: 1437): [Target gene information]: Gene ID: 2042: Symbol:
EPHA3: Ensembl Transcript ID: EN5T00000336596.2: GRCh: 37: Chr: 3: [Target cancer mutation
information]: mut start: 89480460: mut end: 89480460: mut class: Missense Mutation: mut type: SNP: ref
seq: G: mut seq: A: mut aa: p.G766E: mutation info source: CCLE: ref target(-10 +10):
TCTGATTTCGGACTTTCGCGT (SEQ ID NO: 319): mut target(-10 +10):
TCTGATTTCGAACTTTCGCGT (SEQ ID NO: 320): [Model Cell line information]: cell: NCIH2126:

TABLE 7-continued

Illustrative guide RNA sequences for polypeptides comprising Cas9 cancer type: LUNG: PAM dist: 15: indel length: 0: CRISPR gRNA ID: GF-CCELg9-203: [crRNA sequence]:
crRNA sequence: ACTGCCGGGCTCCTGGGCTCAGG (SEQ ID NO: 1438):
SpgRNA: attctaatacgactcactataggACTGCCGGGCTCCTGGGCTCg0itagagctagaaatagcaagttaaaataaggctagtccgtt
atcaacttgaaaaagtggcaccgagtcggtgc (SEQ ID NO: 143 9): [Target gene information]: Gene ID: 2044: Symbol:
EPHA5: Ensembl Transcript ID: EN5T00000273854.3: GRCh: 37: Chr: 4: [Target cancer mutation
information]: mut start: 66356149: mut end: 66356149: mut class: Silent: mut type: SNP: ref seq: A: mut
seq: G: mut aa: p.L450L: mutation info source: CCLE: ref target(-10 +10):
CCTGGGCTCAAGTCGGACACT (SEQ ID NO: 1440): mut target(-10 +10):
CCTGGGCTCAGGTCGGACACT (SEQ ID NO: 1441): [Model Cell line information]: cell: NCIH1299:
cancer type: LUNG: PAM dist: -1: indel length: 0: CRISPR gRNA ID: GF-CCELg9-204: [crRNA sequence]:
crRNA sequence: CCGGGCTCCTGGGCTCAGGTCGG (SEQ ID NO: 1442):
SpgRNA: attctaatacgactcactataggCCGGGCTCCTGGGCTCAGGTg0nagagctagaaatagcaagttaaaataaggctagtccgtt
atcaacttgaaaaagtggcaccgagtcggtgc (SEQ ID NO: 1443): [Target gene information]: Gene ID: 2044: Symbol:
EPHA5: Ensembl Transcript ID: EN5T00000273854.3: GRCh: 37: Chr: 4: [Target cancer mutation
information]: mut start: 66356149: mut end: 66356149: mut class: Silent: mut type: SNP: ref seq: A: mut
seq: G: mut aa: p.L450L: mutation info source: CCLE: ref target(-10 +10):
CCTGGGCTCAAGTCGGACACT (SEQ ID NO: 1440): mut target(-10 +10):
CCTGGGCTCAGGTCGGACACT (SEQ ID NO: 1441): [Model Cell line information]: cell: NCIH1299:
cancer type: LUNG: PAM dist: 3: indel length: 0: CRISPR gRNA ID: GF-CCELg9-205: [crRNA sequence]:
crRNA sequence: GGAGTGTCCGACCTGAGCCCAGG (SEQ ID NO: 1444):
SpgRNA: attctaatacgactcactataggGGAGTGTCCGACCTGAGCCCg0itagagctagaaatagcaagttaaaataaggctagtccgtt
atcaacttgaaaaagtggcaccgagtcggtgc (SEQ ID NO: 1445): [Target gene information]: Gene ID: 2044: Symbol:
EPHA5: Ensembl Transcript ID: EN5T00000273854.3: GRCh: 37: Chr: 4: [Target cancer mutation
information]: mut start: 66356149: mut end: 66356149: mut class: Silent: mut type: SNP: ref seq: A: mut
seq: G: mut aa: p.L450L: mutation info source: CCLE: ref target(-10 +10):
CCTGGGCTCAAGTCGGACACT (SEQ ID NO: 1440): mut target(-10 +10):
CCTGGGCTCAGGTCGGACACT (SEQ ID NO: 1441): [Model Cell line information]: cell: NCIH1299:
cancer type: LUNG: PAM dist: 8: indel length: 0: CRISPR gRNA ID: GF-CCELg9-206: [crRNA sequence]:
crRNA sequence: CCGACCTGAGCCCAGGAGCCGG (SEQ ID NO: 1446):
SpgRNA: attctaatacgactcactataggCCGACCTGAGCCCAGGAGCCg0itagagctagaaatagcaagttaaaataaggctagtccgt
tatcaacttgaaaaagtggcaccgagtcggtgc (SEQ ID NO: 1447): [Target gene information]: Gene ID: 2044: Symbol:
EPHA5: Ensembl Transcript ID: EN5T00000273854.3: GRCh: 37: Chr: 4: [Target cancer mutation
information]: mut start: 66356149: mut end: 66356149: mut class: Silent: mut type: SNP: ref seq: A: mut
seq: G: mut aa: p.L450L: mutation info source: CCLE: ref target(-10 +10):
CCTGGGCTCAAGTCGGACACT (SEQ ID NO: 1440): mut target(-10 +10):
CCTGGGCTCAGGTCGGACACT (SEQ ID NO: 1441): [Model Cell line information]: cell: NCIH1299:
cancer type: LUNG: PAM dist: 15: indel length: 0: CRISPR gRNA ID: GF-CCELg9-207: [crRNA sequence]:
crRNA sequence: AGCAGCCGGCCAGGGACGCTTTGG (SEQ ID NO: 1448):
SpgRNA: attctaatacgactcactataggAGCAGCCGGCCAGGGACGCTg0nagagctagaaatagcaagttaaaataaggctagtccgt
tatcaacttgaaaaagtggcaccgagtcggtgc (SEQ ID NO: 1449): [Target gene information]: Gene ID: 2044: Symbol:
EPHA5: Ensembl Transcript ID: EN5T00000273854.3: GRCh: 37: Chr: 4: [Target cancer mutation
information]: mut start: 66535387: mut end: 66535387: mut class: Missense Mutation: mut type: SNP: ref
seq: G: mut seq: T: mut aa: p.P25Q: mutation info source: CCLE: ref target(-10 +10):
CAGGGACGCTGGGGTGATGGG (SEQ ID NO: 1450): mut target(-10 +10):
CAGGGACGCTTGGGTGATGGG (SEQ ID NO: 1451): [Model Cell line information]: cell: NCIH1299:
cancer type: LUNG: PAM dist: 0: indel length: 0: CRISPR gRNA ID: GF-CCELg9-208: [crRNA sequence]:
crRNA sequence: GGCCAGGGACGCTTTGGGTGATGG (SEQ ID NO: 1452):
SpgRNA: attctaatacgactcactataggGGCCAGGGACGCGCTTGGGTGATGAg0itagagctagaaatagcaagttaaaataaggctagtccgt
tatcaacttgaaaaagtggcaccgagtcggtgc (SEQ ID NO: 1453): [Target gene information]: Gene ID: 2044: Symbol:
EPHA5: Ensembl Transcript ID: ENST00000273854.3: GRCh: 37: Chr: 4: [Target cancer mutation
information]: mut start: 66535387: mut end: 66535387: mut class: Missense Mutation: mut type: SNP: ref
seq: G: mut seq: T: mut aa: p.P25Q: mutation info source: CCLE: ref target(-10 +10):
CAGGGACGCTGGGGTGATGGG (SEQ ID NO: 1450): mut target(-10 +10):
CAGGGACGCTTGGGTGATGGG (SEQ ID NO: 1451): [Model Cell line information]: cell: NCIH1299:
cancer type: LUNG: PAM dist: 7: indel length: 0: CRISPR gRNA ID: GF-CCELg9-209: [crRNA sequence]:
crRNA sequence: GCAGCCGGCCAGGGACGCTTTGGG (SEQ ID NO: 1454):
SpgRNA: attctaatacgactcactataggGCAGCCGGCCAGGGACGCTTgttttagagctagaaatagcaagttaaaataaggctagtccgt
tatcaacttgaaaaagtggcaccgagtcggtgc (SEQ ID NO: 1455): [Target gene information]: Gene ID: 2044: Symbol:
EPHA5: Ensembl Transcript ID: EN5T00000273854.3: GRCh: 37: Chr: 4: [Target cancer mutation
information]: mut start: 66535387: mut end: 66535387: mut class: Missense Mutation: mut type: SNP: ref
seq: G: mut seq: T: mut aa: p.P25Q: mutation info source: CCLE: ref target(-10 +10):
CAGGGACGCTGGGGTGATGGG (SEQ ID NO: 1450): mut target(-10 +10):
CAGGGACGCTTGGGTGATGGG (SEQ ID NO: 1451): [Model Cell line information]: cell: NCIH1299:
cancer type: LUNG: PAM dist: 1: indel length: 0: CRISPR gRNA ID: GF-CCELg9-210: [crRNA sequence]:
crRNA sequence: GCCAGGGACGCTTTGGGTGATGGG (SEQ ID NO: 1456):
SpgRNA: attctaatacgactcactataggGCCAGGGACGCTTGGGTGATgttttagagctagaaatagcaagttaaaataaggctagtccgtt
atcaacttgaaaaagtggcaccgagtcggtgc (SEQ ID NO: 1457): [Target gene information]: Gene ID: 2044: Symbol:
EPHA5: Ensembl Transcript ID: EN5T00000273854.3: GRCh: 37: Chr: 4: [Target cancer mutation
information]: mut start: 66535387: mut end: 66535387: mut class: Missense Mutation: mut type: SNP: ref
seq: G: mut seq: T: mut aa: p.P25Q: mutation info source: CCLE: ref target(-10 +10):
CAGGGACGCTGGGGTGATGGG (SEQ ID NO: 1450): mut target(-10 +10):
CAGGGACGCTTGGGTGATGGG (SEQ ID NO: 1451): [Model Cell line information]: cell: NCIH1299:
cancer type: LUNG: PAM dist: 8: indel length: 0: CRISPR gRNA ID: GF-CCELg9-211: [crRNA sequence]:
crRNA sequence: CCAGGGACGCTTTGGGTGATGGGG (SEQ ID NO: 1458):
SpgRNA: attctaatacgactcactataggCCAGGGACGCTTGGGTGATGgttttagagctagaaatagcaagttaaaataaggctagtccgtt
atcaacttgaaaaagtggcaccgagtcggtgc (SEQ ID NO: 1459): [Target gene information]: Gene ID: 2044: Symbol:
EPHA5: Ensembl Transcript ID: EN5T00000273854.3: GRCh: 37: Chr: 4: [Target cancer mutation
information]: mut start: 66535387: mut end: 66535387: mut class: Missense Mutation: mut type: SNP: ref

TABLE 7-continued

Illustrative guide RNA sequences for polypeptides comprising Cas9 seq: G: mut seq: T: mut aa: p.P25Q: mutation info source: CCLE: ref target(-10 +10):
CAGGGACGCTGGGGTGATGGG (SEQ ID NO: 1450): mut target(-10 +10):
CAGGGACGCTTGGGTGATGGG (SEQ ID NO: 1451): [Model Cell line information]: cell: NCIH1299:
cancer type: LUNG: PAM dist: 9: indel length: 0: CRISPR gRNA ID: GF-CCELg9-212: [crRNA sequence]:
crRNA sequence: CAGGGACGCTTGGGTGATGGGGG (SEQ ID NO: 1460):
SpgRNA: attctaatacgactcactataggCAGGGACGCTTGGGTGATGGgttttagagctagaaatagcaagttaaaataaggctagtccgt
tatcaacttgaaaaagtggcaccgagtcggtgc (SEQ ID NO: 1461): [Target gene information]: Gene ID: 2044: Symbol:
EPHA5: Ensembl Transcript ID: ENST00000273854.3: GRCh: 37: Chr: 4: [Target cancer mutation
information]: mut start: 66535387: mut end: 66535387: mut class: Missense Mutation: mut type: SNP: ref
seq: G: mut seq: T: mut aa: p.P25Q: mutation info source: CCLE: ref target(-10 +10):
CAGGGACGCTGGGGTGATGGG (SEQ ID NO: 1450): mut target(-10 +10):
CAGGGACGCTTGGGTGATGGG (SEQ ID NO: 1451): [Model Cell line information]: cell: NCIH1299:
cancer type: LUNG: PAM dist: 10: indel length: 0: CRISPR gRNA ID: GF-CCELg9-213: [crRNA sequence]:
crRNA sequence: CCCCATCACCCAAGCGTCCCTGG (SEQ ID NO: 1462):
SpgRNA: attctaatacgactcactataggCCCCATCACCCAAGCGTCCCTGGgttttagagctagaaatagcaagttaaaataaggctagtccgtt
atcaacttgaaaaagtggcaccgagtcggtgc (SEQ ID NO: 1463): [Target gene information]: Gene ID: 2044: Symbol:
EPHA5: Ensembl Transcript ID: EN5T00000273854.3: GRCh: 37: Chr: 4: [Target cancer mutation
information]: mut start: 66535387: mut end: 66535387: mut class: Missense Mutation: mut type: SNP: ref
seq: G: mut seq: T: mut aa: p.P25Q: mutation info source: CCLE: ref target(-10 +10):
CAGGGACGCTGGGGTGATGGG (SEQ ID NO: 1450): mut target(-10 +10):
CAGGGACGCTTGGGTGATGGG (SEQ ID NO: 1451): [Model Cell line information]: cell: NCIH1299:
cancer type: LUNG: PAM dist: 9: indel length: 0: CRISPR gRNA ID: GF-CCELg9-214: [crRNA sequence]:
crRNA sequence: ATCACCCAAGCGTCCCTGGCCGG (SEQ ID NO: 1464):
SpgRNA: attctaatacgactcactataggATCACCCAAGCGTCCCTGGCgttttagagctagaaatagcaagttaaaataaggctagtccgtt
atcaacttgaaaaagtggcaccgagtcggtgc (SEQ ID NO: 1465): [Target gene information]: Gene ID: 2044: Symbol:
EPHA5: Ensembl Transcript ID: EN5T00000273854.3: GRCh: 37: Chr: 4: [Target cancer mutation
information]: mut start: 66535387: mut end: 66535387: mut class: Missense Mutation: mut type: SNP: ref
seq: G: mut seq: T: mut aa: p.P25Q: mutation info source: CCLE: ref target(-10 +10):
CAGGGACGCTGGGGTGATGGG (SEQ ID NO: 1450): mut target(-10 +10):
CAGGGACGCTTGGGTGATGGG (SEQ ID NO: 1451): [Model Cell line information]: cell: NCIH1299:
cancer type: LUNG: PAM dist: 13: indel length: 0: CRISPR gRNA ID: GF-CCELg9-215: [crRNA sequence]:
crRNA sequence: ACTGTTGTTTAAGATGTTTCTGG (SEQ ID NO: 1466):
SpgRNA: attctaatacgactcactataggACTGTTGTTTAAGATGTTTCgttttagagctagaaatagcaagttaaaataaggctagtccgtta
tcaacttgaaaaagtggcaccgagtcggtgc (SEQ ID NO: 1467): [Target gene information]: Gene ID: 2044: Symbol:
EPHA5: Ensembl Transcript ID: EN5T00000273854.3: GRCh: 37: Chr: 4: [Target cancer mutation
information]: mut start: 66217192: mut end: 66217192: mut class: Missense Mutation: mut type: SNP: ref
seq: A: mut seq: T: mut aa: p.I808N: mutation info source: CCLE: ref target(-10 +10):
GTTACTGTTGATTAAGATGTT (SEQ ID NO: 325): mut target(-10 +10):
GTTACTGTTGTTTAAGATGTT (SEQ ID NO: 326): [Model Cell line information]: cell: NCIH1573:
cancer type: LUNG: PAM dist: 13: indel length: 0: CRISPR gRNA ID: GF-CCELg9-216: [crRNA sequence]:
crRNA sequence: ACAGAACTTGATCTTGGTGACGG (SEQ ID NO: 1468):
SpgRNA: attctaatacgactcactataggACAGAACTTGATCTTGGTGAgttttagagctagaaatagcaagttaaaataaggctagtccgtt
atcaacttgaaaaagtggcaccgagtcggtgc (SEQ ID NO: 1469): [Target gene information]: Gene ID: 2044: Symbol:
EPHA5: Ensembl Transcript ID: EN5T00000273854.3: GRCh: 37: Chr: 4: [Target cancer mutation
information]: mut start: 66467698: mut end: 66467698: mut class: Missense Mutation: mut type: SNP: ref
seq: G: mut seq: C: mut aa: p.R191G: mutation info source: CCLE: ref target(-10 +10):
TTCATAACACGGTCACCAAGA (SEQ ID NO: 331): mut target(-10 +10):
TTCATAACACGTCACCAAGA (SEQ ID NO: 332): [Model Cell line information]: cell: NCIH2126:
cancer type: LUNG: PAM dist: -1: indel length: 0: CRISPR gRNA ID: GF-CCELg9-217: [crRNA sequence]:
crRNA sequence: TTGGTTACACAGAAAAAAAAAGG (SEQ ID NO: 1470):
SpgRNA: attctaatacgactcactataggTTGGTTACACAGAAAAAAAgttttagagctagaaatagcaagttaaaataaggctagtccgt
tatcaacttgaaaaagtggcaccgagtcggtgc (SEQ ID NO: 1471): [Target gene information]: Gene ID: 2045: Symbol:
EPHA7: Ensembl Transcript ID: EN5T00000369303.4: GRCh: 37: Chr: 6: [Target cancer mutation
information]: mut start: 93967904: mut end: 93967904: mut class: Missense Mutation: mut type: SNP: ref
seq: G: mut seq: T: mut aa: p.Q675K: mutation info source: CCLE: ref target(-10 +10):
TCTCTCCTTTGTTTTCTGTG (SEQ ID NO: 337): mut target(-10 +10): TCTCTCCTTTTTTTTCTGTG
(SEQ ID NO: 338): [Model Cell line information]: cell: CFPAC1: cancer type: PANCREAS: PAM dist: 3:
indel length: 0: CRISPR gRNA ID: GF-CCELg9-218: [crRNA sequence]: crRNA sequence:
TGGTGTTTATTTTTACATAGAGG (SEQ ID NO: 1472):
SpgRNA: attctaatacgactcactataggTGGTGTTTATTTTTACATAGgttttagagctagaaatagcaagttaaaataaggctagtccgtta
tcaacttgaaaaagtggcaccgagtcggtgc (SEQ ID NO: 1473): [Target gene information]: Gene ID: 2045: Symbol:
EPHA7: Ensembl Transcript ID: EN5T00000369303.4: GRCh: 37: Chr: 6: [Target cancer mutation
information]: mut start: 94120612: mut end: 94120612: mut class: Missense Mutation: mut type: SNP: ref
seq: C: mut seq: T: mut aa: p.D147N: mutation info source: CCLE: ref target(-10 +10):
GCAATGGTGTCTATTTTTACA (SEQ ID NO: 347): mut target(-10 +10):
GCAATGGTGTTTATTTTTACA (SEQ ID NO: 348): [Model Cell line information]: cell: NCIH1563:
cancer type: LUNG: PAM dist: 14: indel length: 0: CRISPR gRNA ID: GF-CCELg9-219: [crRNA sequence]:
crRNA sequence: GATGAGTTTAGGGATCACAATGG (SEQ ID NO: 1474):
SpgRNA: attctaatacgactcactataggGATGAGTTTAGGGATCACAAgttttagagctagaaatagcaagttaaaataaggctagtccgtt
atcaacttgaaaaagtggcaccgagtcggtgc (SEQ ID NO: 1475): [Target gene information]: Gene ID: 2045: Symbol:
EPHA7: Ensembl Transcript ID: EN5T00000369303.4: GRCh: 37: Chr: 6: [Target cancer mutation
information]: mut start: 93953233: mut end: 93953233: mut class: Missense Mutation: mut type: SNP: ref
seq: G: mut seq: T: mut aa: p.L970M: mutation info source: CCLE: ref target(-10 +10):
TGACCAACCAGTGTGATCCCT (SEQ ID NO: 353): mut target(-10 +10):
TGACCAACCATTGTGATCCCT (SEQ ID NO: 354): [Model Cell line information]: cell: NCIH1573:
cancer type: LUNG: PAM dist: 1: indel length: 0: CRISPR gRNA ID: GF-CCELg9-220: [crRNA sequence]:
crRNA sequence: AGTTTAGGGATCACAATGGTTGG (SEQ ID NO: 1476):

TABLE 7-continued

Illustrative guide RNA sequences for polypeptides comprising Cas9

SpgRNA: attctaatacgactcactataggAGTTTAGGGATCACAATGGTgttttagagctagaaatagcaagttaaaataaggctagtccgtt
atcaacttgaaaaagtggcaccgagtcggtgc (SEQ ID NO: 1477): [Target gene information]: Gene ID: 2045: Symbol:
EPHA7: Ensembl Transcript ID: EN5T00000369303.4: GRCh: 37: Chr: 6: [Target cancer mutation
information]: mut start: 93953233: mut end: 93953233: mut class: Missense Mutation: mut type: SNP: ref
seq: G: mut seq: T: mut aa: p.L970M: mutation info source: CCLE: ref target(-10 +10):
TGACCAACCAGTGTGATCCCT (SEQ ID NO: 353): mut target(-10 +10):
TGACCAACCATTGTGATCCCT (SEQ ID NO: 354): [Model Cell line information]: cell: NCIH1573:
cancer type: LUNG: PAM dist: 5: indel length: 0: CRISPR gRNA ID: GF-CCELg9-221: [crRNA sequence]:
crRNA sequence: TAAGCGGTGCATTTGGGAGCAGG (SEQ ID NO: 1478):
SpgRNA: attctaatacgactcactataggTAAGCGGTGCATTTGGGAGCgttttagagctagaaatagcaagttaaaataaggctagtccgtt
atcaacttgaaaaagtggcaccgagtcggtgc (SEQ ID NO: 1479): [Target gene information]: Gene ID: 2045: Symbol:
EPHA7: Ensembl Transcript ID: EN5T00000369303.4: GRCh: 37: Chr: 6: [Target cancer mutation
information]: mut start: 94066641: mut end: 94066641: mut class: Missense Mutation: mut type: SNP: ref
seq: C: mut seq: A: mut aa: p.5373I: mutation info source: CCLE: ref target(-10 +10):
CTGCTCCCAACTGCACCGCTT (SEQ ID NO: 365): mut target(-10 +10):
CTGCTCCCAAATGCACCGCTT (SEQ ID NO: 366): [Model Cell line information]: cell: NCIH1573:
cancer type: LUNG: PAM dist: 9: indel length: 0: CRISPR gRNA ID: GF-CCELg9-222: [crRNA sequence]:
crRNA sequence: TATTGTGTAAGCGGTGCATTTGG (SEQ ID NO: 1480):
SpgRNA: attctaatacgactcactataggTATTGTGTAAGCGGTGCATTgttttagagctagaaatagcaagttaaaataaggctagtccgtt
atcaacttgaaaaagtggcaccgagtcggtgc (SEQ ID NO: 1481): [Target gene information]: Gene ID: 2045: Symbol:
EPHA7: Ensembl Transcript ID: EN5T00000369303.4: GRCh: 37: Chr: 6: [Target cancer mutation
information]: mut start: 94066641: mut end: 94066641: mut class: Missense Mutation: mut type: SNP: ref
seq: C: mut seq: A: mut aa: p.5373I: mutation info source: CCLE: ref target(-10 +10):
CTGCTCCCAACTGCACCGCTT (SEQ ID NO: 365): mut target(-10 +10):
CTGCTCCCAAATGCACCGCTT (SEQ ID NO: 366): [Model Cell line information]: cell: NCIH1573:
cancer type: LUNG: PAM dist: 2: indel length: 0: CRISPR gRNA ID: GF-CCELg9-223: [crRNA sequence]:
crRNA sequence: ATTGTGTAAGCGGTGCATTTGGG (SEQ ID NO: 1482):
SpgRNA: attctaatacgactcactataggATTGTGTAAGCGGTGCATTTgttttagagctagaaatagcaagttaaaataaggctagtccgtt
atcaacttgaaaaagtggcaccgagtcggtgc (SEQ ID NO: 1483): [Target gene information]: Gene ID: 2045: Symbol:
EPHA7: Ensembl Transcript ID: EN5T00000369303.4: GRCh: 37: Chr: 6: [Target cancer mutation
information]: mut start: 94066641: mut end: 94066641: mut class: Missense Mutation: mut type: SNP: ref
seq: C: mut seq: A: mut aa: p.5373I: mutation info source: CCLE: ref target(-10 +10):
CTGCTCCCAACTGCACCGCTT (SEQ ID NO: 365): mut target(-10 +10):
CTGCTCCCAAATGCACCGCTT (SEQ ID NO: 366): [Model Cell line information]: cell: NCIH1573:
cancer type: LUNG: PAM dist: 3: indel length: 0: CRISPR gRNA ID: GF-CCELg9-224: [crRNA sequence]:
crRNA sequence: AAGCGGTGCATTTGGGAGCAGGG (SEQ ID NO: 1484):
SpgRNA: attctaatacgactcactataggAAGCGGTGCATTTGGGAGCAgttttagagctagaaatagcaagttaaaataaggctagtccgt
tatcaacttgaaaaagtggcaccgagtcggtgc (SEQ ID NO: 1485): [Target gene information]: Gene ID: 2045: Symbol:
EPHA7: Ensembl Transcript ID: EN5T00000369303.4: GRCh: 37: Chr: 6: [Target cancer mutation
information]: mut start: 94066641: mut end: 94066641: mut class: Missense Mutation: mut type: SNP: ref
seq: C: mut seq: A: mut aa: p.5373I: mutation info source: CCLE: ref target(-10 +10):
CTGCTCCCAACTGCACCGCTT (SEQ ID NO: 365): mut target(-10 +10):
CTGCTCCCAAATGCACCGCTT (SEQ ID NO: 366): [Model Cell line information]: cell: NCIH1573:
cancer type: LUNG: PAM dist: 10: indel length: 0: CRISPR gRNA ID: GF-CCELg9-225: [crRNA sequence]:
crRNA sequence: TTCTTTTTCAGTATTACTGCTGG (SEQ ID NO: 1486):
SpgRNA: attctaatacgactcactataggTTCTTTTTCAGTATTACTGCgttttagagctagaaatagcaagttaaaataaggctagtccgttat
caacttgaaaaagtggcaccgagtcggtgc (SEQ ID NO: 1487): [Target gene information]: Gene ID: 2045: Symbol:
EPHA7: Ensembl Transcript ID: EN5T00000369303.4: GRCh: 37: Chr: 6: [Target cancer mutation
information]: mut start: 94124483: mut end: 94124483: mut class: Silent: mut type: SNP: ref seq: G: mut
seq: A: mut aa: p.L34L: mutation info source: CCLE: ref target(-10 +10): TCCAGCAGTAGTACTGAAAAA
(SEQ ID NO: 369): mut target(-10 +10): TCCAGCAGTAATACTGAAAAA (SEQ ID NO: 370): [Model
Cell line information]: cell: NCIH1573: cancer type: LUNG: PAM dist: 7: indel length: 0: CRISPR gRNA
ID: GF-CCELg9-226: [crRNA sequence]: crRNA sequence: AGGGGAGTTTTCAGACTATTTGG (SEQ ID
NO: 1488):
SpgRNA: attctaatacgactcactataggAGGGGAGTTTTCAGACTATTgttttagagctagaaatagcaagttaaaataaggctagtccgtt
atcaacttgaaaaagtggcaccgagtcggtgc (SEQ ID NO: 1489): [Target gene information]: Gene ID: 2045: Symbol:
EPHA7: Ensembl Transcript ID: EN5T00000369303.4: GRCh: 37: Chr: 6: [Target cancer mutation
information]: mut start: 93956546: mut end: 93956546: mut class: Frame Shift Del: mut type: DEL: ref seq:
G: mut seq: -: mut aa: p.P897fs: mutation info source: CCLE: ref target(-10 +10):
CAGACTATTTGGGTTTCGAAT (SEQ ID NO: 383): mut target(-10 +10): CAGACTATTT-
GGTTTCGAAT (SEQ ID NO: 384): [Model Cell line information]: cell: NCIH460: cancer type: LUNG:
PAM dist: 0: indel length: 1: CRISPR gRNA ID: GF-CCELg9-227: [crRNA sequence]: crRNA sequence:
TGCTGCAAGCCCTGTGCCCGAGG (SEQ ID NO: 1490):
SpgRNA: attctaatacgactcactataggTGCTGCAAGCCCTGTGCCCGghnagagctagaaatagcaagttaaaataaggctagtccgtt
atcaacttgaaaaagtggcaccgagtcggtgc (SEQ ID NO: 1491): [Target gene information]: Gene ID: 2064: Symbol:
ERBB2: Ensembl Transcript ID: EN5T00000269571.5: GRCh: 37: Chr: 17: [Target cancer mutation
information]: mut start: 37868282: mut end: 37868282: mut class: Missense Mutation: mut type: SNP: ref
seq: A: mut seq: T: mut aa: p.5335C: mutation info source: CCLE: ref target(-10 +10):
TGAGAAGTGCAGCAAGCCCTG (SEQ ID NO: 1492): mut target(-10 +10):
TGAGAAGTGCTTGCAAGCCCTG (SEQ ID NO: 1493): [Model Cell line information]: cell: NCIH1563:
cancer type: LUNG: PAM dist: 17: indel length: 0: CRISPR gRNA ID: GF-CCELg9-228: [crRNA sequence]:
crRNA sequence: TCTTACATTTGCAGCCTGTAAGG (SEQ ID NO: 1494):
SpgRNA: attctaatacgactcactataggTCTTACATTTGCAGCCTGTAgthiagagctagaaatagcaagttaaaataaggctagtccgtta
tcaacttgaaaaagtggcaccgagtcggtgc (SEQ ID NO: 1495): [Target gene information]: Gene ID: 2065: Symbol:
ERBB3: Ensembl Transcript ID: EN5T00000267101.3: GRCh: 37: Chr: 12: [Target cancer mutation
information]: mut start: 56482537: mut end: 56482537: mut class: Missense Mutation: mut type: SNP: ref
seq: G: mut seq: A: mut aa: p.E332K: mutation info source: CCLE: ref target(-10 +10):
TGCAGCCTGTGAGGGAACAGG (SEQ ID NO: 391): mut target(-10 +10):

TABLE 7-continued

Illustrative guide RNA sequences for polypeptides comprising Cas9

TGCAGCCTGTAAGGGAACAGG (SEQ ID NO: 392): [Model Cell line information]: cell: NCIH1573:
cancer type: LUNG: PAM dist: 1: indel length: 0: CRISPR gRNA ID: GF-CCELg9-229: [crRNA sequence]:
crRNA sequence: TTTGCAGCCTGTAAGGGAACAGG (SEQ ID NO: 1496):
SpgRNA: attctaatacgactcactataggTTTGCAGCCTGTAAGGGAACGthiagagctagaaatagcaagttaaaataaggctagtccgtt
atcaacttgaaaaagtggcaccgagtcggtgc (SEQ ID NO: 1497): [Target gene information]: Gene ID: 2065: Symbol:
ERBB3: Ensembl Transcript ID: EN5T00000267101.3: GRCh: 37: Chr: 12: [Target cancer mutation
information]: mut start: 56482537: mut end: 56482537: mut class: Missense Mutation: mut type: SNP: ref
seq: G: mut seq: A: mut aa: p.E332K: mutation info source: CCLE: ref target(-10 +10):
TGCAGCCTGTGAGGGAACAGG (SEQ ID NO: 391): mut target(-10 +10):
TGCAGCCTGTAAGGGAACAGG (SEQ ID NO: 392): [Model Cell line information]: cell: NCIH1573:
cancer type: LUNG: PAM dist: 8: indel length: 0: CRISPR gRNA ID: GF-CCELg9-230: [crRNA sequence]:
crRNA sequence: GCCTGTAAGGGAACAGGCTCTGG (SEQ ID NO: 1498):
SpgRNA: attctaatacgactcactataggGCCTGTAAGGGAACAGGCTCgthiagagctagaaatagcaagttaaaataaggctagtccgt
tatcaacttgaaaaagtggcaccgagtcggtgc (SEQ ID NO: 1499): [Target gene information]: Gene ID: 2065: Symbol:
ERBB3: Ensembl Transcript ID: ENST00000267101.3: GRCh: 37: Chr: 12: [Target cancer mutation
information]: mut start: 56482537: mut end: 56482537: mut class: Missense Mutation: mut type: SNP: ref
seq: G: mut seq: A: mut aa: p.E332K: mutation info source: CCLE: ref target(-10 +10):
TGCAGCCTGTGAGGGAACAGG (SEQ ID NO: 391): mut target(-10 +10):
TGCAGCCTGTAAGGGAACAGG (SEQ ID NO: 392): [Model Cell line information]: cell: NCIH1573:
cancer type: LUNG: PAM dist: 14: indel length: 0: CRISPR gRNA ID: GF-CCELg9-231: [crRNA sequence]:
crRNA sequence: CTTACATTTGCAGCCTGTAAGGG (SEQ ID NO: 1500):
SpgRNA: attctaatacgactcactataggCTTACATTTGCAGCCTGTAAgttttagagctagaaatagcaagttaaaataaggctagtccgtt
atcaacttgaaaaagtggcaccgagtcggtgc (SEQ ID NO: 1501): [Target gene information]: Gene ID: 2065: Symbol:
ERBB3: Ensembl Transcript ID: EN5T00000267101.3: GRCh: 37: Chr: 12: [Target cancer mutation
information]: mut start: 56482537: mut end: 56482537: mut class: Missense Mutation: mut type: SNP: ref
seq: G: mut seq: A: mut aa: p.E332K: mutation info source: CCLE: ref target(-10 +10):
TGCAGCCTGTGAGGGAACAGG (SEQ ID NO: 391): mut target(-10 +10):
TGCAGCCTGTAAGGGAACAGG (SEQ ID NO: 392): [Model Cell line information]: cell: NCIH1573:
cancer type: LUNG: PAM dist: 2: indel length: 0: CRISPR gRNA ID: GF-CCELg9-232: [crRNA sequence]:
crRNA sequence: CCTGTAAGGGAACAGGCTCTGGG (SEQ ID NO: 1502):
SpgRNA: attctaatacgactcactataggCCTGTAAGGGAACAGGCTCTGttttagagctagaaatagcaagttaaaataaggctagtccgtt
atcaacttgaaaaagtggcaccgagtcggtgc (SEQ ID NO: 1503): [Target gene information]: Gene ID: 2065: Symbol:
ERBB3: Ensembl Transcript ID: EN5T00000267101.3: GRCh: 37: Chr: 12: [Target cancer mutation
information]: mut start: 56482537: mut end: 56482537: mut class: Missense Mutation: mut type: SNP: ref
seq: G: mut seq: A: mut aa: p.E332K: mutation info source: CCLE: ref target(-10 +10):
TGCAGCCTGTGAGGGAACAGG (SEQ ID NO: 391): mut target(-10 +10):
TGCAGCCTGTAAGGGAACAGG (SEQ ID NO: 392): [Model Cell line information]: cell: NCIH1573:
cancer type: LUNG: PAM dist: 15: indel length: 0: CRISPR gRNA ID: GF-CCELg9-233: [crRNA sequence]:
crRNA sequence: CCCAGAGCCTGTTCCCTTACAGG (SEQ ID NO: 1504):
SpgRNA: attctaatacgactcactataggCCCAGAGCCTGTTCCCTTACAGgttttagagctagaaatagcaagttaaaataaggctagtccgtt
atcaacttgaaaaagtggcaccgagtcggtgc (SEQ ID NO: 1505): [Target gene information]: Gene ID: 2065: Symbol:
ERBB3: Ensembl Transcript ID: EN5T00000267101.3: GRCh: 37: Chr: 12: [Target cancer mutation
information]: mut start: 56482537: mut end: 56482537: mut class: Missense Mutation: mut type: SNP: ref
seq: G: mut seq: A: mut aa: p.E332K: mutation info source: CCLE: ref target(-10 +10):
TGCAGCCTGTGAGGGAACAGG (SEQ ID NO: 391): mut target(-10 +10):
TGCAGCCTGTAAGGGAACAGG (SEQ ID NO: 392): [Model Cell line information]: cell: NCIH1573:
cancer type: LUNG: PAM dist: 3: indel length: 0: CRISPR gRNA ID: GF-CCELg9-234: [crRNA sequence]:
crRNA sequence: CAACAAGCTAACTTTCCAGTTGG (SEQ ID NO: 1506):
SpgRNA: attctaatacgactcactataggCAACAAGCTAACTTTCCAGTgttttagagctagaaatagcaagttaaaataaggctagtccgtt
atcaacttgaaaaagtggcaccgagtcggtgc (SEQ ID NO: 1507): [Target gene information]: Gene ID: 2065: Symbol:
ERBB3: Ensembl Transcript ID: EN5T00000267101.3: GRCh: 37: Chr: 12: [Target cancer mutation
information]: mut start: 56481886: mut end: 56481886: mut class: Silent: mut type: SNP: ref seq: C: mut
seq: T: mut aa: p.L272L: mutation info source: CCLE: ref target(-10 +10):
AACTTTCCAGCTGGAACCCAA (SEQ ID NO: 395): mut target(-10 +10):
AACTTTCCAGTTGGAACCCAA (SEQ ID NO: 396): [Model Cell line information]: cell: NCIH2126:
cancer type: LUNG: PAM dist: 1: indel length: 0: CRISPR gRNA ID: GF-CCELg9-235: [crRNA sequence]:
crRNA sequence: TGTGGGGATTGGGTTCCAACTGG (SEQ ID NO: 1508):
SpgRNA: attctaatacgactcactataggTGTGGGGATTGGGTTCCAACgttttagagctagaaatagcaagttaaaataaggctagtccgtt
atcaacttgaaaaagtggcaccgagtcggtgc (SEQ ID NO: 1509): [Target gene information]: Gene ID: 2065: Symbol:
ERBB3: Ensembl Transcript ID: ENST00000267101.3: GRCh: 37: Chr: 12: [Target cancer mutation
information]: mut start: 56481886: mut end: 56481886: mut class: Silent: mut type: SNP: ref seq: C: mut
seq: T: mut aa: p.L272L: mutation info source: CCLE: ref target(-10 +10):
AACTTTCCAGCTGGAACCCAA (SEQ ID NO: 395): mut target(-10 +10):
AACTTTCCAGTTGGAACCCAA (SEQ ID NO: 396): [Model Cell line information]: cell: NCIH2126:
cancer type: LUNG: PAM dist: 2: indel length: 0: CRISPR gRNA ID: GF-CCELg9-236: [crRNA sequence]:
crRNA sequence: TCTGCGTGCTACTGTCCTCTTGG (SEQ ID NO: 1510):
SpgRNA: attctaatacgactcactataggTCTGCGTGCTACTGTCCTCTgttttagagctagaaatagcaagttaaaataaggctagtccgtta
tcaacttgaaaaagtggcaccgagtcggtgc (SEQ ID NO: 1511): [Target gene information]: Gene ID: 2066: Symbol:
ERBB4: Ensembl Transcript ID: EN5T00000342788.4: GRCh: 37: Chr: 2: [Target cancer mutation
information]: mut start: 212251684: mut end: 212251684: mut class: Silent: mut type: SNP: ref seq: G: mut
seq: C: mut aa: p.T1125T: mutation info source: CCLE: ref target(-10 +10):
TGTACCTCTGGGTGCTACTGT (SEQ ID NO: 1512): mut target(-10 +10):
TGTACCTCTGCCGTGCTACTGT (SEQ ID NO: 1513): [Model Cell line information]: cell: NCIH1573:
cancer type: LUNG: PAM dist: 16: indel length: 0: CRISPR gRNA ID: GF-CCELg9-237: [crRNA sequence]:
crRNA sequence: AAGAGGACAGTAGCACGCAGAGG (SEQ ID NO: 1514):
SpgRNA: attctaatacgactcactataggAAGAGGACAGTAGCACGCAGgttttagagctagaaatagcaagttaaaataaggctagtccg
ttatcaacttgaaaaagtggcaccgagtcggtgc (SEQ ID NO: 1515): [Target gene information]: Gene ID: 2066:
Symbol: ERBB4: Ensembl Transcript ID: EN5T00000342788.4: GRCh: 37: Chr: 2: [Target cancer mutation TABLE 7-continued Illustrative guide RNA sequences for polypeptides comprising Cas9 information]: mut start: 212251684: mut end: 212251684: mut class: Silent: mut type: SNP: ref seq: G: mut
seq: C: mut aa: p.T1125T: mutation info source: CCLE: ref target(-10 +10):
TGTACCTCTGGGTGCTACTGT (SEQ ID NO: 1512): mut target(-10 +10):
TGTACCTCTGCGTGCTACTGT (SEQ ID NO: 1513): [Model Cell line information]: cell: NCIH1573:
cancer type: LUNG: PAM dist: 4: indel length: 0: CRISPR gRNA ID: GF-CCELg9-238: [crRNA sequence]:
crRNA sequence: GACGCGTTCAGCACAGAATCTGG (SEQ ID NO: 1516):
SpgRNA: attctaatacgactcactataggGACGCGTTCAGCACAGAATCGttttagagctagaaatagcaagttaaaataaggctagtccgtt
atcaacttgaaaaagtggcaccgagtcggtgc (SEQ ID NO: 1517): [Target gene information]: Gene ID: 2068: Symbol:
ERCC2: Ensembl Transcript ID: EN5T00000391945.4: GRCh: 37: Chr: 19: [Target cancer mutation
information]: mut start: 45864884: mut end: 45864884: mut class: Missense Mutation: mut type: SNP: ref
seq: G: mut seq: C: mut aa: p.L379V: mutation info source: CCLE: ref target(-10 +10):
AGGGACCGGAGGCGTTCAGCA (SEQ ID NO: 1518): mut target(-10 +10):
AGGGACCGGACGCGTTCAGCA (SEQ ID NO: 1519): [Model Cell line information]: cell: NCIH661:
cancer type: LUNG: PAM dist: 18: indel length: 0: CRISPR gRNA ID: GF-CCELg9-239: [crRNA sequence]:
crRNA sequence: GATTCTGTGCTGAACGCGTCCGG (SEQ ID NO: 1520):
SpgRNA: attctaatacgactcactataggGATTCTGTGCTGAACGCGTCgttttagagctagaaatagcaagttaaaataaggctagtccgtt
atcaacttgaaaaagtggcaccgagtcggtgc (SEQ ID NO: 1521): [Target gene information]: Gene ID: 2068: Symbol:
ERCC2: Ensembl Transcript ID: EN5T00000391945.4: GRCh: 37: Chr: 19: [Target cancer mutation
information]: mut start: 45864884: mut end: 45864884: mut class: Missense Mutation: mut type: SNP: ref
seq: G: mut seq: C: mut aa: p.L379V: mutation info source: CCLE: ref target(-10 +10):
AGGGACCGGAGGCGTTCAGCA (SEQ ID NO: 1518): mut target(-10 +10):
AGGGACCGGACGCGTTCAGCA (SEQ ID NO: 1519): [Model Cell line information]: cell: NCIH661:
cancer type: LUNG: PAM dist: 3: indel length: 0: CRISPR gRNA ID: GF-CCELg9-240: [crRNA sequence]:
crRNA sequence: GCTCAGCTTCTATGAGAAGCAGG (SEQ ID NO: 1522):
SpgRNA: attctaatacgactcactataggGCTCAGCTTCTATGAGAAGCGttttagagctagaaatagcaagttaaaataaggctagtccgtt
atcaacttgaaaaagtggcaccgagtcggtgc (SEQ ID NO: 1523): [Target gene information]: Gene ID: 2068: Symbol:
ERCC2: Ensembl Transcript ID: EN5T00000391945.4: GRCh: 37: Chr: 19: [Target cancer mutation
information]: mut start: 45871973: mut end: 45871973: mut class: Missense Mutation: mut type: SNP: ref
seq: T: mut seq: C: mut aa: p.N925: mutation info source: CCLE: ref target(-10 +10):
CTCATAGAAGTTGAGCAACTT (SEQ ID NO: 1524): mut target(-10 +10):
CTCATAGAAGCTGAGCAACTT (SEQ ID NO: 1525): [Model Cell line information]: cell: 5W1990:
cancer type: PANCREAS: PAM dist: 15: indel length: 0: CRISPR gRNA ID: GF-CCELg9-241: [crRNA
sequence]: crRNA sequence: CAGCTTCTATGAGAAGCAGGAGG (SEQ ID NO: 1526):
SpgRNA: attctaatacgactcactataggCAGCTTCTATGAGAAGCAGGgttttagagctagaaatagcaagttaaaataaggctagtccgtt
atcaacttgaaaaagtggcaccgagtcggtgc (SEQ ID NO: 1527): [Target gene information]: Gene ID: 2068: Symbol:
ERCC2: Ensembl Transcript ID: EN5T00000391945.4: GRCh: 37: Chr: 19: [Target cancer mutation
information]: mut start: 45871973: mut end: 45871973: mut class: Missense Mutation: mut type: SNP: ref
seq: T: mut seq: C: mut aa: p.N925: mutation info source: CCLE: ref target(-10 +10):
CTCATAGAAGTTGAGCAACTT (SEQ ID NO: 1524): mut target(-10 +10):
CTCATAGAAGCTGAGCAACTT (SEQ ID NO: 1525): [Model Cell line information]: cell: 5W1990:
cancer type: PANCREAS: PAM dist: 18: indel length: 0: CRISPR gRNA ID: GF-CCELg9-242: [crRNA
sequence]: crRNA sequence: AGCTTCTATGAGAAGCAGGAGGG (SEQ ID NO: 1528):
SpgRNA: attctaatacgactcactataggAGCTTCTATGAGAAGCAGGAgttttagagctagaaatagcaagttaaaataaggctagtccgt
tatcaacttgaaaaagtggcaccgagtcggtgc (SEQ ID NO: 1529): [Target gene information]: Gene ID: 2068: Symbol:
ERCC2: Ensembl Transcript ID: EN5T00000391945.4: GRCh: 37: Chr: 19: [Target cancer mutation
information]: mut start: 45871973: mut end: 45871973: mut class: Missense Mutation: mut type: SNP: ref
seq: T: mut seq: C: mut aa: p.N925: mutation info source: CCLE: ref target(-10 +10):
CTCATAGAAGTTGAGCAACTT (SEQ ID NO: 1524): mut target(-10 +10):
CTCATAGAAGCTGAGCAACTT (SEQ ID NO: 1525): [Model Cell line information]: cell: 5W1990:
cancer type: PANCREAS: PAM dist: 19: indel length: 0: CRISPR gRNA ID: GF-CCELg9-243: [crRNA
sequence]: crRNA sequence: TAAAAAATATTGTTACTCTTTGG (SEQ ID NO: 1530):
SpgRNA: attctaatacgactcactataggTAAAAAATATTGTTACTCTTTagagctagaaatagcaagttaaaataaggctagtccgtta
tcaacttgaaaaagtggcaccgagtcggtgc (SEQ ID NO: 1531): [Target gene information]: Gene ID: 2073: Symbol:
ERCC5: Ensembl Transcript ID: EN5T00000355739.4: GRCh: 37: Chr: 13: [Target cancer mutation
informa-
tion]: mut start: 103520461: mut end: 103520461: mut class: Splice Site: mut type: SNP: ref seq: A:
mut seq: G: mut aa: -: mutation info source: CCLE: ref target(-10 +10): GTTACTCTTTAGGATTGGACC
(SEQ ID NO: 399): mut target(-10 +10): GTTACTCTTTGGGATTGGACC (SEQ ID NO: 400): [Model
Cell line information]: cell: NCIH1573: cancer type: LUNG: PAM dist: -1: indel length: 0: CRISPR gRNA
ID: GF-CCELg9-244: [crRNA sequence]: crRNA sequence: ATATTGTTACTCTTTGGGATTGG (SEQ ID
NO: 1532):
SpgRNA: attctaatacgactcactataggATATTGTTACTCTTTGGGATgttttagagctagaaatagcaagttaaaataaggctagtccgtta
tcaacttgaaaaagtggcaccgagtcggtgc (SEQ ID NO: 1533): [Target gene information]: Gene ID: 2073: Symbol:
ERCC5: Ensembl Transcript ID: EN5T00000355739.4: GRCh: 37: Chr: 13: [Target cancer mutation
informa-
tion]: mut start: 103520461: mut end: 103520461: mut class: Splice Site: mut type: SNP: ref seq: A:
mut seq: G: mut aa: -: mutation info source: CCLE: ref target(-10 +10): GTTACTCTTTAGGATTGGACC
(SEQ ID NO: 399): mut target(-10 +10): GTTACTCTTTGGGATTGGACC (SEQ ID NO: 400): [Model
Cell line information]: cell: NCIH1573: cancer type: LUNG: PAM dist: 5: indel length: 0: CRISPR gRNA
ID: GF-CCELg9-245: [crRNA sequence]: crRNA sequence: GTTACTCTTTGGGATTGGACCGG (SEQ ID
NO: 1534):
SpgRNA: attctaatacgactcactataggGTTACTCTTTGGGATTGGACg agagctagaaatagcaagttaaaataaggctagtccgtt
atcaacttgaaaaagtggcaccgagtcggtgc (SEQ ID NO: 153 5): [Target gene information]: Gene ID: 2073: Symbol:
ERCC5: Ensembl Transcript ID: EN5T00000355739.4: GRCh: 37: Chr: 13: [Target cancer mutation
informa-
tion]: mut start: 103520461: mut end: 103520461: mut class: Splice Site: mut type: SNP: ref seq: A:
mut seq: G: mut aa: -: mutation info source: CCLE: ref target(-10 +10): GTTACTCTTTAGGATTGGACC
(SEQ ID NO: 399): mut target(-10 +10): GTTACTCTTTGGGATTGGACC (SEQ ID NO: 400): [Model TABLE 7-continued Illustrative guide RNA sequences for polypeptides comprising Cas9

Cell line information]: cell: NCIH1573: cancer type: LUNG: PAM dist: 10: indel length: 0: CRISPR gRNA
ID: GF-CCELg9-246: [crRNA sequence]: crRNA sequence: AAAAAATATTGTTACTCTTTGGG (SEQ ID
NO: 1536):
SpgRNA: attctaatacgactcactataggAAAAAATATTGTTACTCTTTgttttagagctagaaatagcaagttaaaataaggctagtccgtta
tcaacttgaaaaagtggcaccgagtcggtgc (SEQ ID NO: 1537): [Target gene information]: Gene ID: 2073: Symbol:
ERCC5: Ensembl Transcript ID: EN5T00000355739.4: GRCh: 37: Chr: 13: [Target cancer mutation
informa-
tion]: mut start: 103520461: mut end: 103520461: mut class: Splice Site: mut type: SNP: ref seq: A:
mut seq: G: mut aa: -: mutation info source: CCLE: ref target(-10 +10): GTTACTCTTTAGGATTGGACC
(SEQ ID NO: 399): mut target(-10 +10): GTTACTCTTTGGGATTGGACC (SEQ ID NO: 400): [Model
Cell line information]: cell: NCIH1573: cancer type: LUNG: PAM dist: 0: indel length: 0: CRISPR gRNA
ID: GF-CCELg9-247: [crRNA sequence]: crRNA sequence: GCTGCCATAGTTCATCCCAACGG (SEQ ID
NO: 1538):
SpgRNA: attctaatacgactcactataggGCTGCCATAGTTCATCCCAAg agagctagaaatagcaagttaaaataaggctagtccgtt
atcaacttgaaaaagtggcaccgagtcggtgc (SEQ ID NO: 153 9): [Target gene information]: Gene ID: 2078: Symbol:
ERG: Ensembl Transcript ID: EN5T00000417133.2: GRCh: 37: Chr: 21: [Target cancer mutation
information]: mut start: 39795408: mut end: 39795408: mut class: Silent: mut type: SNP: ref seq: G: mut
seq: A: mut aa: p.Y111Y: mutation info source: CCLE: ref target(-10 +10):
TGTAGCTGCCGTAGTTCATCC (SEQ ID NO: 1540): mut target(-10 +10):
TGTAGCTGCCATAGTTCATCC (SEQ ID NO: 1541): [Model Cell line information]: cell: NCIH1299:
cancer type: LUNG: PAM dist: 14: indel length: 0: CRISPR gRNA ID: GF-CCELg9-248: [crRNA sequence]:
crRNA sequence: GAACTATGGCAGCTACATGGAGG (SEQ ID NO: 1542):
SpgRNA: attctaatacgactcactataggGAACTATGGCAGCTACATGgagagctagaaatagcaagttaaaataaggctagtccgtt
atcaacttgaaaaagtggcaccgagtcggtgc (SEQ ID NO: 1543): [Target gene information]: Gene ID: 2078: Symbol:
ERG: Ensembl Transcript ID: EN5T00000417133.2: GRCh: 37: Chr: 21: [Target cancer mutation
information]: mut start: 39795408: mut end: 39795408: mut class: Silent: mut type: SNP: ref seq: G: mut
seq: A: mut aa: p.Y111Y: mutation info source: CCLE: ref target(-10 +10):
TGTAGCTGCCGTAGTTCATCC (SEQ ID NO: 1540): mut target(-10 +10):
TGTAGCTGCCATAGTTCATCC (SEQ ID NO: 1541): [Model Cell line information]: cell: NCIH1299:
cancer type: LUNG: PAM dist: 14: indel length: 0: CRISPR gRNA ID: GF-CCELg9-249: [crRNA sequence]:
crRNA sequence: GACACCGTTGGGATGAACTATGG (SEQ ID NO: 1544):
SpgRNA: attctaatacgactcactataggGACACCGTTGGGATGAACTAgttttagagctagaaatagcaagttaaaataaggctagtccgtt
atcaacttgaaaaagtggcaccgagtcggtgc (SEQ ID NO: 1545): [Target gene information]: Gene ID: 2078: Symbol:
ERG: Ensembl Transcript ID: EN5T00000417133.2: GRCh: 37: Chr: 21: [Target cancer mutation
information]: mut start: 39795408: mut end: 39795408: mut class: Silent: mut type: SNP: ref seq: G: mut
seq: A: mut aa: p.Y111Y: mutation info source: CCLE: ref target(-10 +10):
TGTAGCTGCCGTAGTTCATCC (SEQ ID NO: 1540): mut target(-10 +10):
TGTAGCTGCCATAGTTCATCC (SEQ ID NO: 1541): [Model Cell line information]: cell: NCIH1299:
cancer type: LUNG: PAM dist: 0: indel length: 0: CRISPR gRNA ID: GF-CCELg9-250: [crRNA sequence]:
crRNA sequence: GATGAACTATGGCAGCTACATG (SEQ ID NO: 1546):
SpgRNA: attctaatacgactcactataggGATGAACTATGGCAGCTACAgttttagagctagaaatagcaagttaaaataaggctagtccgtt
atcaacttgaaaaagtggcaccgagtcggtgc (SEQ ID NO: 1547): [Target gene information]: Gene ID: 2078: Symbol:
ERG: Ensembl Transcript ID: EN5T00000417133.2: GRCh: 37: Chr: 21: [Target cancer mutation
information]: mut start: 39795408: mut end: 39795408: mut class: Silent: mut type: SNP: ref seq: G: mut
seq: A: mut aa: p.Y111Y: mutation info source: CCLE: ref target(-10 +10):
TGTAGCTGCCGTAGTTCATCC (SEQ ID NO: 1540): mut target(-10 +10):
TGTAGCTGCCATAGTTCATCC (SEQ ID NO: 1541): [Model Cell line information]: cell: NCIH1299:
cancer type: LUNG: PAM dist: 11: indel length: 0: CRISPR gRNA ID: GF-CCELg9-251: [crRNA sequence]:
crRNA sequence: CTGGCCACACTGCATTCATCAGG (SEQ ID NO: 1548):
SpgRNA: attctaatacgactcactataggCTGGCCACACTGCATTCATCgttttagagctagaaatagcaagttaaaataaggctagtccgtt
atcaacttgaaaaagtggcaccgagtcggtgc (SEQ ID NO: 1549): [Target gene information]: Gene ID: 2078: Symbol:
ERG: Ensembl Transcript ID: EN5T00000417133.2: GRCh: 37: Chr: 21: [Target cancer mutation
information]: mut start: 39795454: mut end: 39795454: mut class: Missense Mutation: mut type: SNP: ref
seq: T: mut seq: C: mut aa: p.K96R: mutation info source: CCLE: ref target(-10 +10):
CTTCCCGCCTTTGGCCACACT (SEQ ID NO: 1550): mut target(-10 +10):
CTTCCCGCCTCTGGCCACACT (SEQ ID NO: 1551): [Model Cell line information]: cell: NCIH1650:
cancer type: LUNG: PAM dist: 20: indel length: 0: CRISPR gRNA ID: GF-CCELg9-252: [crRNA sequence]:
crRNA sequence: GCCCACCATCTTCCCGCCTCTGG (SEQ ID NO: 1552):
SpgRNA: attctaatacgactcactataggGCCCACCATCTTCCCGCCTCgttttagagctagaaatagcaagttaaaataaggctagtccgtta
tcaacttgaaaaagtggcaccgagtcggtgc (SEQ ID NO: 1553): [Target gene information]: Gene ID: 2078: Symbol:
ERG: Ensembl Transcript ID: EN5T00000417133.2: GRCh: 37: Chr: 21: [Target cancer mutation
information]: mut start: 39795454: mut end: 39795454: mut class: Missense Mutation: mut type: SNP: ref
seq: T: mut seq: C: mut aa: p.K96R: mutation info source: CCLE: ref target(-10 +10):
CTTCCCGCCTTTGGCCACACT (SEQ ID NO: 1550): mut target(-10 +10):
CTTCCCGCCTCTGGCCACACT (SEQ ID NO: 1551): [Model Cell line information]: cell: NCIH1650:
cancer type: LUNG: PAM dist: 1: indel length: 0: CRISPR gRNA ID: GF-CCELg9-253: [crRNA sequence]:
crRNA sequence: GATGAATGCAGTGTGGCCAGAGG (SEQ ID NO: 1554):
SpgRNA: attctaatacgactcactataggGATGAATGCAGTGTGGCCAGgttttagagctagaaatagcaagttaaaataaggctagtccgt
tatcaacttgaaaaagtggcaccgagtcggtgc (SEQ ID NO: 1555): [Target gene information]: Gene ID: 2078: Symbol:
ERG: Ensembl Transcript ID: EN5T00000417133.2: GRCh: 37: Chr: 21: [Target cancer mutation
information]: mut start: 39795454: mut end: 39795454: mut class: Missense Mutation: mut type: SNP: ref
seq: T: mut seq: C: mut aa: p.K96R: mutation info source: CCLE: ref target(-10 +10):
CTTCCCGCCTTTGGCCACACT (SEQ ID NO: 1550): mut target(-10 +10):
CTTCCCGCCTCTGGCCACACT (SEQ ID NO: 1551): [Model Cell line information]: cell: NCIH1650:
cancer type: LUNG: PAM dist: 1: indel length: 0: CRISPR gRNA ID: GF-CCELg9-254: [crRNA sequence]:
crRNA sequence: TGTGGCCAGAGGCGGGAAGATGG (SEQ ID NO: 1556):
SpgRNA: attctaatacgactcactataggTGTGGCCAGAGGCGGGAAGAgttttagagctagaaatagcaagttaaaataaggctagtccgt
tatcaacttgaaaaagtggcaccgagtcggtgc (SEQ ID NO: 1557): [Target gene information]: Gene ID: 2078: Symbol:

TABLE 7-continued

Illustrative guide RNA sequences for polypeptides comprising Cas9

ERG: Ensembl Transcript ID: EN5T00000417133.2: GRCh: 37: Chr: 21: [Target cancer mutation
information]: mut start: 39795454: mut end: 39795454: mut class: Missense Mutation: mut type: SNP: ref
seq: T: mut seq: C: mut aa: p.K96R: mutation info source: CCLE: ref target(-10 +10):
CTTCCCGCCTTTGGCCACACT (SEQ ID NO: 1550): mut target(-10 +10):
CTTCCCGCCTCTGGCCACACT (SEQ ID NO: 1551): [Model Cell line information]: cell: NCIH1650:
cancer type: LUNG: PAM dist: 12: indel length: 0: CRISPR gRNA ID: GF-CCELg9-255: [crRNA sequence]:
crRNA sequence: GGCCAGAGGCGGGAAGATGGTGG (SEQ ID NO: 1558):
SpgRNA: attctaatacgactcactataggGGCCAGAGGCGGGAAGATGGTgttttagagctagaaatagcaagttaaaataaggctagtccg
ttatcaacttgaaaaagtggcaccgagtcggtgc (SEQ ID NO: 1559): [Target gene information]: Gene ID: 2078:
Symbol: ERG: Ensembl Transcript ID: EN5T00000417133.2: GRCh: 37: Chr: 21: [Target cancer mutation
information]: mut start: 39795454: mut end: 39795454: mut class: Missense Mutation: mut type: SNP: ref
seq: T: mut seq: C: mut aa: p.K96R: mutation info source: CCLE: ref target(-10 +10):
CTTCCCGCCTTTGGCCACACT (SEQ ID NO: 1550): mut target(-10 +10):
CTTCCCGCCTCTGGCCACACT (SEQ ID NO: 1551): [Model Cell line information]: cell: NCIH1650:
cancer type: LUNG: PAM dist: 15: indel length: 0: CRISPR gRNA ID: GF-CCELg9-256: [crRNA sequence]:
crRNA sequence: GAATGCAGTGTGGCCAGAGGCGG (SEQ ID NO: 1560):
SpgRNA: attctaatacgactcactataggGAATGCAGTGTGGCCAGAGGgttttagagctagaaatagcaagttaaaataaggctagtccgt
tatcaacttgaaaaagtggcaccgagtcggtgc (SEQ ID NO: 1561): [Target gene information]: Gene ID: 2078: Symbol:
ERG: Ensembl Transcript ID: ENST00000417133.2: GRCh: 37: Chr: 21: [Target cancer mutation
information]: mut start: 39795454: mut end: 39795454: mut class: Missense Mutation: mut type: SNP: ref
seq: T: mut seq: C: mut aa: p.K96R: mutation info source: CCLE: ref target(-10 +10):
CTTCCCGCCTTTGGCCACACT (SEQ ID NO: 1550): mut target(-10 +10):
CTTCCCGCCTCTGGCCACACT (SEQ ID NO: 1551): [Model Cell line information]: cell: NCIH1650:
cancer type: LUNG: PAM dist: 4: indel length: 0: CRISPR gRNA ID: GF-CCELg9-257: [crRNA sequence]:
crRNA sequence: AATGCAGTGTGGCCAGAGGCGGG (SEQ ID NO: 1562):
SpgRNA: attctaatacgactcactataggAATGCAGTGTGGCCAGAGGCgttttagagctagaaatagcaagttaaaataaggctagtccgt
tatcaacttgaaaaagtggcaccgagtcggtgc (SEQ ID NO: 1563): [Target gene information]: Gene ID: 2078: Symbol:
ERG: Ensembl Transcript ID: EN5T00000417133.2: GRCh: 37: Chr: 21: [Target cancer mutation
information]: mut start: 39795454: mut end: 39795454: mut class: Missense Mutation: mut type: SNP: ref
seq: T: mut seq: C: mut aa: p.K96R: mutation info source: CCLE: ref target(-10 +10):
CTTCCCGCCTTTGGCCACACT (SEQ ID NO: 1550): mut target(-10 +10):
CTTCCCGCCTCTGGCCACACT (SEQ ID NO: 1551): [Model Cell line information]: cell: NCIH1650:
cancer type: LUNG: PAM dist: 5: indel length: 0: CRISPR gRNA ID: GF-CCELg9-258: [crRNA sequence]:
crRNA sequence: GCCAGAGGCGGGAAGATGGTGGG (SEQ ID NO: 1564):
SpgRNA: attctaatacgactcactataggGCCAGAGGCGGGAAGATGGTgttttagagctagaaatagcaagttaaaataaggctagtccgt
tatcaacttgaaaaagtggcaccgagtcggtgc (SEQ ID NO: 1565): [Target gene information]: Gene ID: 2078: Symbol:
ERG: Ensembl Transcript ID: EN5T00000417133.2: GRCh: 37: Chr: 21: [Target cancer mutation
information]: mut start: 39795454: mut end: 39795454: mut class: Missense Mutation: mut type: SNP: ref
seq: T: mut seq: C: mut aa: p.K96R: mutation info source: CCLE: ref target(-10 +10):
CTTCCCGCCTTTGGCCACACT (SEQ ID NO: 1550): mut target(-10 +10):
CTTCCCGCCTCTGGCCACACT (SEQ ID NO: 1551): [Model Cell line information]: cell: NCIH1650:
cancer type: LUNG: PAM dist: 16: indel length: 0: CRISPR gRNA ID: GF-CCELg9-259: [crRNA sequence]:
crRNA sequence: GGGAACTCTGGGGGAACCTCAGG (SEQ ID NO: 1566):
SpgRNA: attctaatacgactcactataggGGGAACTCTGGGGGAACCTCgttttagagctagaaatagcaagttaaaataaggctagtccgt
tatcaacttgaaaaagtggcaccgagtcggtgc (SEQ ID NO: 1567): [Target gene information]: Gene ID: 54206:
Symbol: ERRFI1: Ensembl Transcript ID: EN5T00000377482.5: GRCh: 37: Chr: 1: [Target cancer mutation
informa-
tion]: mut start: 8073804: mut end: 8073804: mut class: Frame Shift Del: mut type: DEL: ref seq: G:
mut seq: -: mut aa: p.P285fs: mutation info source: CCLE: ref target(-10 +10):
TGGGAACTCTGGGGGGAACCT (SEQ ID NO: 1568): mut target(-10 +10): TGGGAACTCT-
GGGGGAACCT (SEQ ID NO: 1569): [Model Cell line information]: cell: NCIH1563: cancer type: LUNG:
PAM dist: 12: indel length: 1: CRISPR gRNA ID: GF-CCELg9-260: [crRNA sequence]: crRNA sequence:
TCTAGGAGGTATGGGAACTCTGG (SEQ ID NO: 1570):
SpgRNA: attctaatacgactcactataggTCTAGGAGGTATGGGAACTCgliftagagctagaaatagcaagttaaaataaggctagtccgtt
atcaacttgaaaaagtggcaccgagtcggtgc (SEQ ID NO: 1571): [Target gene information]: Gene ID: 54206:
Symbol: ERRFI1: Ensembl Transcript ID: EN5T00000377482.5: GRCh: 37: Chr: 1: [Target cancer mutation
informa-
tion]: mut start: 8073804: mut end: 8073804: mut class: Frame Shift Del: mut type: DEL: ref seq: G:
mut seq: -: mut aa: p.P285fs: mutation info source: CCLE: ref target(-10 +10):
TGGGAACTCTGGGGGGAACCT (SEQ ID NO: 1568): mut target(-10 +10): TGGGAACTCT-
GGGGGAACCT (SEQ ID NO: 1569): [Model Cell line information]: cell: NCIH1563: cancer type: LUNG:
PAM dist: 0: indel length: 1: CRISPR gRNA ID: GF-CCELg9-261: [crRNA sequence]: crRNA sequence:
CTAGGAGGTATGGGAACTCTGGG (SEQ ID NO: 1572):
SpgRNA: attctaatacgactcactataggCTAGGAGGTATGGGAACTCTgliftagagctagaaatagcaagttaaaataaggctagtccgtt
atcaacttgaaaaagtggcaccgagtcggtgc (SEQ ID NO: 1573): [Target gene information]: Gene ID: 54206:
Symbol: ERRFI1: Ensembl Transcript ID: EN5T00000377482.5: GRCh: 37: Chr: 1: [Target cancer mutation
informa-
tion]: mut start: 8073804: mut end: 8073804: mut class: Frame Shift Del: mut type: DEL: ref seq: G:
mut seq: -: mut aa: p.P285fs: mutation info source: CCLE: ref target(-10 +10):
TGGGAACTCTGGGGGGAACCT (SEQ ID NO: 1568): mut target(-10 +10): TGGGAACTCT-
GGGGGAACCT (SEQ ID NO: 1569): [Model Cell line information]: cell: NCIH1563: cancer type: LUNG:
PAM dist: 1: indel length: 1: CRISPR gRNA ID: GF-CCELg9-262: [crRNA sequence]: crRNA sequence:
TAGGAGGTATGGGAACTCTGGGG (SEQ ID NO: 1574):
SpgRNA: attctaatacgactcactataggTAGGAGGTATGGGAACTCTGgliftagagctagaaatagcaagttaaaataaggctagtccgtt
atcaacttgaaaaagtggcaccgagtcggtgc (SEQ ID NO: 1575): [Target gene information]: Gene ID: 54206:

TABLE 7-continued

Illustrative guide RNA sequences for polypeptides comprising Cas9

Symbol: ERRFI1: Ensembl Transcript ID: EN5T00000377482.5: GRCh: 37: Chr: 1: [Target cancer mutation information]: mut start: 8073804: mut end: 8073804: mut class: Frame Shift Del: mut type: DEL: ref seq: G: mut seq: -: mut aa: p.P285fs: mutation info source: CCLE: ref target(-10 +10): TGGGAACTCTGGGGGGAACCT (SEQ ID NO: 1568): mut target(-10 +10): TGGGAACTCT-GGGGGAACCT (SEQ ID NO: 1569): [Model Cell line information]: cell: NCIH1563: cancer type: LUNG: PAM dist: 2: indel length: 1: CRISPR gRNA ID: GF-CCELg9-263: [crRNA sequence]: crRNA sequence: AGGAGGTATGGGAACTCTTGGGGG (SEQ ID NO: 1576):
SpgRNA: attctaatacgactcactataggAGGAGGTATGGGAACTCTGGgilftagagctagaaatagcaagttaaaataaggctagtccgt tatcaacttgaaaaagtggcaccgagtcggtgc (SEQ ID NO: 1577): [Target gene information]: Gene ID: 54206: Symbol: ERRFI1: Ensembl Transcript ID: EN5T00000377482.5: GRCh: 37: Chr: 1: [Target cancer mutation information]: mut start: 8073804: mut end: 8073804: mut class: Frame Shift Del: mut type: DEL: ref seq: G: mut seq: -: mut aa: p.P285fs: mutation info source: CCLE: ref target(-10 +10): TGGGAACTCTGGGGGGAACCT (SEQ ID NO: 1568): mut target(-10 +10): TGGGAACTCT-GGGGGAACCT (SEQ ID NO: 1569): [Model Cell line information]: cell: NCIH1563: cancer type: LUNG: PAM dist: 3: indel length: 1: CRISPR gRNA ID: GF-CCELg9-264: [crRNA sequence]: crRNA sequence: CTCGGAGACACGCTATTGAGTGG (SEQ ID NO: 1578):
SpgRNA: attctaatacgactcactataggCTCGGAGACACGCTATTGAGgttftagagctagaaatagcaagttaaaataaggctagtccgtt atcaacttgaaaaagtggcaccgagtcggtgc (SEQ ID NO: 1579): [Target gene information]: Gene ID: 2099: Symbol: ESR1: Ensembl Transcript ID: EN5T00000206249.3: GRCh: 37: Chr: 6: [Target cancer mutation information]: mut start: 152129350: mut end: 152129350: mut class: Silent: mut type: SNP: ref seq: C: mut seq: T: mut aa: p.N101N: mutation info source: CCLE: ref target(-10 +10): CCCCACTCAACAGCGTGTCTC (SEQ ID NO: 405): mut target(-10 +10): CCCCACTCAATAGCGTGTCTC (SEQ ID NO: 406): [Model Cell line information]: cell: NCIH1650: cancer type: LUNG: PAM dist: 6: indel length: 0: CRISPR gRNA ID: GF-CCELg9-265: [crRNA sequence]: crRNA sequence: TCGGAGACACGCTATTGAGTGGG (SEQ ID NO: 1580):
SpgRNA: attctaatacgactcactataggTCGGAGACACGCTATTGAGTgttttagagctagaaatagcaagttaaaataaggctagtccgtt atcaacttgaaaaagtggcaccgagtcggtgc (SEQ ID NO: 1581): [Target gene information]: Gene ID: 2099: Symbol: ESR1: Ensembl Transcript ID: EN5T00000206249.3: GRCh: 37: Chr: 6: [Target cancer mutation information]: mut start: 152129350: mut end: 152129350: mut class: Silent: mut type: SNP: ref seq: C: mut seq: T: mut aa: p.N101N: mutation info source: CCLE: ref target(-10 +10): CCCCACTCAACAGCGTGTCTC (SEQ ID NO: 405): mut target(-10 +10): CCCCACTCAATAGCGTGTCTC (SEQ ID NO: 406): [Model Cell line information]: cell: NCIH1650: cancer type: LUNG: PAM dist: 7: indel length: 0: CRISPR gRNA ID: GF-CCELg9-266: [crRNA sequence]: crRNA sequence: CGGAGACACGCTATTGAGTGGGG (SEQ ID NO: 1582):
SpgRNA: attctaatacgactcactataggCGGAGACACGCTATTGAGTGGgittttagagctagaaatagcaagttaaaataaggctagtccgtt atcaacttgaaaaagtggcaccgagtcggtgc (SEQ ID NO: 1583): [Target gene information]: Gene ID: 2099: Symbol: ESR1: Ensembl Transcript ID: EN5T00000206249.3: GRCh: 37: Chr: 6: [Target cancer mutation information]: mut start: 152129350: mut end: 152129350: mut class: Silent: mut type: SNP: ref seq: C: mut seq: T: mut aa: p.N101N: mutation info source: CCLE: ref target(-10 +10): CCCCACTCAACAGCGTGTCTC (SEQ ID NO: 405): mut target(-10 +10): CCCCACTCAATAGCGTGTCTC (SEQ ID NO: 406): [Model Cell line information]: cell: NCIH1650: cancer type: LUNG: PAM dist: 8: indel length: 0: CRISPR gRNA ID: GF-CCELg9-267: [crRNA sequence]: crRNA sequence: GGAGACACGCTATTGAGTGGGGG (SEQ ID NO: 1584):
SpgRNA: attctaatacgactcactataggGGAGACACGCTATTGAGTGGgttttagagctagaaatagcaagttaaaataaggctagtccgt tatcaacttgaaaaagtggcaccgagtcggtgc (SEQ ID NO: 1585): [Target gene information]: Gene ID: 2099: Symbol: ESR1: Ensembl Transcript ID: ENST00000206249.3: GRCh: 37: Chr: 6: [Target cancer mutation information]: mut start: 152129350: mut end: 152129350: mut class: Silent: mut type: SNP: ref seq: C: mut seq: T: mut aa: p.N101N: mutation info source: CCLE: ref target(-10 +10): CCCCACTCAACAGCGTGTCTC (SEQ ID NO: 405): mut target(-10 +10): CCCCACTCAATAGCGTGTCTC (SEQ ID NO: 406): [Model Cell line information]: cell: NCIH1650: cancer type: LUNG: PAM dist: 9: indel length: 0: CRISPR gRNA ID: GF-CCELg9-268: [crRNA sequence]: crRNA sequence: GAGACACGCTATTGAGTGGGGGG (SEQ ID NO: 1586):
SpgRNA: attctaatacgactcactataggGAGACACGCTATTGAGTGGGgittagagctagaaatagcaagttaaaataaggctagtccgt tatcaacttgaaaaagtggcaccgagtcggtgc (SEQ ID NO: 1587): [Target gene information]: Gene ID: 2099: Symbol: ESR1: Ensembl Transcript ID: EN5T00000206249.3: GRCh: 37: Chr: 6: [Target cancer mutation information]: mut start: 152129350: mut end: 152129350: mut class: Silent: mut type: SNP: ref seq: C: mut seq: T: mut aa: p.N101N: mutation info source: CCLE: ref target(-10 +10): CCCCACTCAACAGCGTGTCTC (SEQ ID NO: 405): mut target(-10 +10): CCCCACTCAATAGCGTGTCTC (SEQ ID NO: 406): [Model Cell line information]: cell: NCIH1650: cancer type: LUNG: PAM dist: 10: indel length: 0: CRISPR gRNA ID: GF-CCELg9-269: [crRNA sequence]: crRNA sequence: CTACTTTCAGCCTGATAGTCTGG (SEQ ID NO: 1588):
SpgRNA: attctaatacgactcactataggCTACTTTCAGCCTGATAGTCTgttttagagctagaaatagcaagttaaaataaggctagtccgtta tcaacttgaaaaagtggcaccgagtcggtgc (SEQ ID NO: 1589): [Target gene information]: Gene ID: 2115: Symbol: ETV1: Ensembl Transcript ID: EN5T00000430479.1: GRCh: 37: Chr: 7: [Target cancer mutation information]: mut start: 14017052: mut end: 14017052: mut class: Splice Site: mut type: SNP: ref seq: A: mut seq: T: mut aa: p.L79M: mutation info source: CCLE: ref target(-10 +10): CTATACTTACAACTTTCAGCC (SEQ ID NO: 409): mut target(-10 +10): CTATACTTACTACTTTCAGCC (SEQ ID NO: 410): [Model Cell line information]: cell: NCIH2126: cancer type: LUNG: PAM dist: 19: indel length: 0: CRISPR gRNA ID: GF-CCELg9-270: [crRNA sequence]: crRNA sequence: AGGCTTCATACATCTTCCCTAGG (SEQ ID NO: 1590):
SpgRNA: attctaatacgactcactataggAGGCTTCATACATCTTCCCTAGgttttagagctagaaatagcaagttaaaataaggctagtccgtta tcaacttgaaaaagtggcaccgagtcggtgc (SEQ ID NO: 1591): [Target gene information]: Gene ID: 2176: Symbol: FANCC: Ensembl Transcript ID: ENST00000289081.3: GRCh: 9: [Target cancer mutation information]: mut start: 98011438: mut end: 98011438: mut class: Missense Mutation: mut type: SNP: ref seq: T: mut seq: C: mut aa: p.R46G: mutation info source: CCLE: ref target(-10 +10): TACATCTTCCTTAGGAACTCC (SEQ ID NO: 413): mut target(-10 +10):

TABLE 7-continued

Illustrative guide RNA sequences for polypeptides comprising Cas9

TACATCTTCCCTAGGAACTCC (SEQ ID NO: 414): [Model Cell line information]: cell: NCIH661:
cancer type: LUNG: PAM dist: 2: indel length: 0: CRISPR gRNA ID: GF-CCELg9-271: [crRNA sequence]:
crRNA sequence: ACATCTTCCCTAGGAACTCCTGG (SEQ ID NO: 1592):
SpgRNA: attctaatacgactcactataggACATCTTCCCTAGGAACTCCgttttagagctagaaatagcaagttaaaataaggctagtccgtt
atcaacttgaaaaagtggcaccgagtcggtgc (SEQ ID NO: 1593): [Target gene information]: Gene ID: 2176: Symbol:
FANCC: Ensembl Transcript ID: ENST00000289081.3: GRCh: 37: Chr: 9: [Target cancer mutation
information]: mut start: 98011438: mut end: 98011438: mut class: Missense Mutation: mut type: SNP: ref
seq: T: mut seq: C: mut aa: p.R46G: mutation info source: CCLE: ref target(-10 +10):
TACATCTTCCTTAGGAACTCC (SEQ ID NO: 413): mut target(-10 +10):
TACATCTTCCCTAGGAACTCC (SEQ ID NO: 414): [Model Cell line information]: cell: NCIH661:
cancer type: LUNG: PAM dist: 11: indel length: 0: CRISPR gRNA ID: GF-CCELg9-272: [crRNA sequence]:
crRNA sequence: GCTCAGTTCCAGGAGTTCCTAGG (SEQ ID NO: 1594):
SpgRNA: attctaatacgactcactataggGCTCAGTTCCAGGAGTTCCTgttttagagctagaaatagcaagttaaaataaggctagtccgtt
atcaacttgaaaaagtggcaccgagtcggtgc (SEQ ID NO: 1595): [Target gene information]: Gene ID: 2176: Symbol:
FANCC: Ensembl Transcript ID: ENST00000289081.3: GRCh: 37: Chr: 9: [Target cancer mutation
information]: mut start: 98011438: mut end: 98011438: mut class: Missense Mutation: mut type: SNP: ref
seq: T: mut seq: C: mut aa: p.R46G: mutation info source: CCLE: ref target(-10 +10):
TACATCTTCCTTAGGAACTCC (SEQ ID NO: 413): mut target(-10 +10):
TACATCTTCCCTAGGAACTCC (SEQ ID NO: 414): [Model Cell line information]: cell: NCIH661:
cancer type: LUNG: PAM dist: -1: indel length: 0: CRISPR gRNA ID: GF-CCELg9-273: [crRNA sequence]:
crRNA sequence: CTCAGTTCCAGGAGTTCCTAGGG (SEQ ID NO: 1596):
SpgRNA: attctaatacgactcactataggCTCAGTTCCAGGAGTTCCTAgttttagagctagaaatagcaagttaaaataaggctagtccgtt
atcaacttgaaaaagtggcaccgagtcggtgc (SEQ ID NO: 1597): [Target gene information]: Gene ID: 2176: Symbol:
FANCC: Ensembl Transcript ID: ENST00000289081.3: GRCh: 37: Chr: 9: [Target cancer mutation
information]: mut start: 98011438: mut end: 98011438: mut class: Missense Mutation: mut type: SNP: ref
seq: T: mut seq: C: mut aa: p.R46G: mutation info source: CCLE: ref target(-10 +10):
TACATCTTCCTTAGGAACTCC (SEQ ID NO: 413): mut target(-10 +10):
TACATCTTCCCTAGGAACTCC (SEQ ID NO: 414): [Model Cell line information]: cell: NCIH661:
cancer type: LUNG: PAM dist: 0: indel length: 0: CRISPR gRNA ID: GF-CCELg9-274: [crRNA sequence]:
crRNA sequence: AAAGTCCAGCAACAGCAGCTTGG (SEQ ID NO: 1598):
SpgRNA: attctaatacgactcactataggAAAGTCCAGCAACAGCAGCTGgttttagagctagaaatagcaagttaaaataaggctagtccgt
tatcaacttgaaaaagtggcaccgagtcggtgc (SEQ ID NO: 1599): [Target gene information]: Gene ID: 55294:
Symbol: FBXW7: Ensembl Transcript ID: ENST00000281708.4: GRCh: 37: Chr: 4: [Target cancer mutation
information]: mut start: 153244062: mut end: 153244062: mut class: Missense Mutation: mut type: SNP: ref
seq: C: mut seq: A: mut aa: p.V699L: mutation info source: CCLE: ref target(-10 +10):
AAGTCCAGCACCAGCAGCTTG (SEQ ID NO: 1600): mut target(-10 +10):
AAGTCCAGCAACAGCAGCTTG (SEQ ID NO: 1601): [Model Cell line information]: cell: NCIH1573:
cancer type: LUNG: PAM dist: 9: indel length: 0: CRISPR gRNA ID: GF-CCELg9-275: [crRNA sequence]:
crRNA sequence: AGAAACCAAGCTGCTGTTGCTGG (SEQ ID NO: 1602):
SpgRNA: attctaatacgactcactataggAGAAACCAAGCTGCTGTTGCgttttagagctagaaatagcaagttaaaataaggctagtccgtt
atcaacttgaaaaagtggcaccgagtcggtgc (SEQ ID NO: 1603): [Target gene information]: Gene ID: 55294:
Symbol: FBXW7: Ensembl Transcript ID: ENST00000281708.4: GRCh: 37: Chr: 4: [Target cancer mutation
information]: mut start: 153244062: mut end: 153244062: mut class: Missense Mutation: mut type: SNP: ref
seq: C: mut seq: A: mut aa: p.V699L: mutation info source: CCLE: ref target(-10 +10):
AAGTCCAGCACCAGCAGCTTG (SEQ ID NO: 1600): mut target(-10 +10):
AAGTCCAGCAACAGCAGCTTG (SEQ ID NO: 1601): [Model Cell line information]: cell: NCIH1573:
cancer type: LUNG: PAM dist: 4: indel length: 0: CRISPR gRNA ID: GF-CCELg9-276: [crRNA sequence]:
crRNA sequence: GCTGTTGCTGGACTTTGATGTGG (SEQ ID NO: 1604):
SpgRNA: attctaatacgactcactataggGCTGTTGCTGGACTTTGATGgttttagagctagaaatagcaagttaaaataaggctagtccgtt
atcaacttgaaaaagtggcaccgagtcggtgc (SEQ ID NO: 1605): [Target gene information]: Gene ID: 55294:
Symbol: FBXW7: Ensembl Transcript ID: ENST00000281708.4: GRCh: 37: Chr: 4: [Target cancer mutation
information]: mut start: 153244062: mut end: 153244062: mut class: Missense Mutation: mut type: SNP: ref
seq: C: mut seq: A: mut aa: p.V699L: mutation info source: CCLE: ref target(-10 +10):
AAGTCCAGCACCAGCAGCTTG (SEQ ID NO: 1600): mut target(-10 +10):
AAGTCCAGCAACAGCAGCTTG (SEQ ID NO: 1601): [Model Cell line information]: cell: NCIH1573:
cancer type: LUNG: PAM dist: 16: indel length: 0: CRISPR gRNA ID: GF-CCELg9-277: [crRNA sequence]:
crRNA sequence: GGAGTGGGGGAGTTGTGTGACGG (SEQ ID NO: 1606):
SpgRNA: attctaatacgactcactataggGGAGTGGGGGAGTTGTGTGAgttttagagctagaaatagcaagttaaaataaggctagtccgt
tatcaacttgaaaaagtggcaccgagtcggtgc (SEQ ID NO: 1607): [Target gene information]: Gene ID: 55294:
Symbol: FBXW7: Ensembl Transcript ID: ENST00000281708.4: GRCh: 37: Chr: 4: [Target cancer mutation
information]: mut start: 153244138: mut end: 153244138: mut class: Nonsense Mutation: mut type: SNP: ref
seq: C: mut seq: T: mut aa: p.W673*: mutation info source: CCLE: ref target(-10 +10):
CTCTGATCCGCCACACAACTC (SEQ ID NO: 423): mut target(-10 +10):
CTCTGATCCGTCACACAACTC (SEQ ID NO: 424): [Model Cell line information]: cell: NCIH1573:
cancer type: LUNG: PAM dist: 1: indel length: 0: CRISPR gRNA ID: GF-CCELg9-278: [crRNA sequence]:
crRNA sequence: AGTGGAAGTATACCCATATAAGG (SEQ ID NO: 1608):
SpgRNA: attctaatacgactcactataggAGTGGAAGTATACCCATATAgttttagagctagaaatagcaagttaaaataaggctagtccgtt
atcaacttgaaaaagtggcaccgagtcggtgc (SEQ ID NO: 1609): [Target gene information]: Gene ID: 55294:
Symbol: FBXW7: Ensembl Transcript ID: ENST00000281708.4: GRCh: 37: Chr: 4: [Target cancer mutation
information]: mut start: 153249400: mut end: 153249400: mut class: Missense Mutation: mut type: SNP: ref
seq: G: mut seq: A: mut aa: p.H460Y: mutation info source: CCLE: ref target(-10 +10):
GTGGAAGTATGCCCATATAAG (SEQ ID NO: 1610): mut target(-10 +10):
GTGGAAGTATACCCATATAAG (SEQ ID NO: 1611): [Model Cell line information]: cell: SW1116:
cancer type: -: PAM dist: 9: indel length: 0: CRISPR gRNA ID: GF-CCELg9-279: [crRNA sequence]:
crRNA sequence: CCTTCATGGTGGGCGACACTTGG (SEQ ID NO: 1612):
SpgRNA: attctaatacgactcactataggCCTTCATGGTGGGCGACACTgttttagagctagaaatagcaagttaaaataaggctagtccgtt
atcaacttgaaaaagtggcaccgagtcggtgc (SEQ ID NO: 1613): [Target gene information]: Gene ID: 2249: Symbol:
FGF4: Ensembl Transcript ID: EN5T00000168712.1: GRCh: 37: Chr: 11: [Target cancer mutation TABLE 7-continued Illustrative guide RNA sequences for polypeptides comprising Cas9 information]: mut start: 69588123: mut end: 69588123: mut class: Missense Mutation: mut type: SNP: ref
seq: C: mut seq: T: mut aa: p.R192Q: mutation info source: CCLE: ref target(-10 +10):
GGGCGACACTCGGTTCCCCTT (SEQ ID NO: 1614): mut target(-10 +10):
GGGCGACACTTGGTTCCCCTT (SEQ ID NO: 1615): [Model Cell line information]: cell: HCC827GR5:
cancer type: LUNG: PAM dist: 0: indel length: 0: CRISPR gRNA ID: GF-CCELg9-280: [crRNA sequence]:
crRNA sequence: CGACACTTGGTTCCCCTTCTTGG (SEQ ID NO: 1616):
SpgRNA: attctaatacgactcactataggCGACACTTGGTTCCCCTTCTgttttagagctagaaatagcaagttaaaataaggctagtccgtta
tcaacttgaaaaagtggcaccgagtcggtgc (SEQ ID NO: 1617): [Target gene information]: Gene ID: 2249: Symbol:
FGF4: Ensembl Transcript ID: EN5T00000168712.1: GRCh: 37: Chr: 11: [Target cancer mutation
information]: mut start: 69588123: mut end: 69588123: mut class: Missense Mutation: mut type: SNP: ref
seq: C: mut seq: T: mut aa: p.R192Q: mutation info source: CCLE: ref target(-10 +10):
GGGCGACACTCGGTTCCCCTT (SEQ ID NO: 1614): mut target(-10 +10):
GGGCGACACTTGGTTCCCCTT (SEQ ID NO: 1615): [Model Cell line information]: cell: HCC827GR5:
cancer type: LUNG: PAM dist: 13: indel length: 0: CRISPR gRNA ID: GF-CCELg9-281: [crRNA sequence]:
crRNA sequence: CCAAGTGTCGCCCACCATGAAGG (SEQ ID NO: 1618):
SpgRNA: attctaatacgactcactataggCCAAGTGTCGCCCACCATGAgttttagagctagaaatagcaagttaaaataaggctagtccgtt
atcaacttgaaaaagtggcaccgagtcggtgc (SEQ ID NO: 1619): [Target gene information]: Gene ID: 2249: Symbol:
FGF4: Ensembl Transcript ID: EN5T00000168712.1: GRCh: 37: Chr: 11: [Target cancer mutation
information]: mut start: 69588123: mut end: 69588123: mut class: Missense Mutation: mut type: SNP: ref
seq: C: mut seq: T: mut aa: p.R192Q: mutation info source: CCLE: ref target(-10 +10):
GGGCGACACTCGGTTCCCCTT (SEQ ID NO: 1614): mut target(-10 +10):
GGGCGACACTTGGTTCCCCTT (SEQ ID NO: 1615): [Model Cell line information]: cell: HCC827GR5:
cancer type: LUNG: PAM dist: 18: indel length: 0: CRISPR gRNA ID: GF-CCELg9-282: [crRNA sequence]:
crRNA sequence: CCTTCATGGTGGGCGACACTTGG (SEQ ID NO: 1612):
SpgRNA: attctaatacgactcactataggCCTTCATGGTGGGCGACACTgttttagagctagaaatagcaagttaaaataaggctagtccgtt
atcaacttgaaaaagtggcaccgagtcggtgc (SEQ ID NO: 1613): [Target gene information]: Gene ID: 2249: Symbol:
FGF4: Ensembl Transcript ID: EN5T00000168712.1: GRCh: 37: Chr: 11: [Target cancer mutation
information]: mut start: 69588123: mut end: 69588123: mut class: Missense Mutation: mut type: SNP: ref
seq: C: mut seq: T: mut aa: p.R192Q: mutation info source: CCLE: ref target(-10 +10):
GGGCGACACTCGGTTCCCCTT (SEQ ID NO: 1614): mut target(-10 +10):
GGGCGACACTTGGTTCCCCTT (SEQ ID NO: 1615): [Model Cell line information]: cell: HCC827:
cancer type: LUNG: PAM dist: 0: indel length: 0: CRISPR gRNA ID: GF-CCELg9-283: [crRNA sequence]:
crRNA sequence: CGACACTTGGTTCCCCTTCTTGG (SEQ ID NO: 1616):
SpgRNA: attctaatacgactcactataggCGACACTTGGTTCCCCTTCTgttttagagctagaaatagcaagttaaaataaggctagtccgtta
tcaacttgaaaaagtggcaccgagtcggtgc (SEQ ID NO: 1617): [Target gene information]: Gene ID: 2249: Symbol:
FGF4: Ensembl Transcript ID: EN5T00000168712.1: GRCh: 37: Chr: 11: [Target cancer mutation
information]: mut start: 69588123: mut end: 69588123: mut class: Missense Mutation: mut type: SNP: ref
seq: C: mut seq: T: mut aa: p.R192Q: mutation info source: CCLE: ref target(-10 +10):
GGGCGACACTCGGTTCCCCTT (SEQ ID NO: 1614): mut target(-10 +10):
GGGCGACACTTGGTTCCCCTT (SEQ ID NO: 1615): [Model Cell line information]: cell: HCC827:
cancer type: LUNG: PAM dist: 13: indel length: 0: CRISPR gRNA ID: GF-CCELg9-284: [crRNA sequence]:
crRNA sequence: CCAAGTGTCGCCCACCATGAAGG (SEQ ID NO: 1618):
SpgRNA: attctaatacgactcactataggCCAAGTGTCGCCCACCATGAgttttagagctagaaatagcaagttaaaataaggctagtccgtt
atcaacttgaaaaagtggcaccgagtcggtgc (SEQ ID NO: 1619): [Target gene information]: Gene ID: 2249: Symbol:
FGF4: Ensembl Transcript ID: EN5T00000168712.1: GRCh: 37: Chr: 11: [Target cancer mutation
information]: mut start: 69588123: mut end: 69588123: mut class: Missense Mutation: mut type: SNP: ref
seq: C: mut seq: T: mut aa: p.R192Q: mutation info source: CCLE: ref target(-10 +10):
GGGCGACACTCGGTTCCCCTT (SEQ ID NO: 1614): mut target(-10 +10):
GGGCGACACTTGGTTCCCCTT (SEQ ID NO: 1615): [Model Cell line information]: cell: HCC827:
cancer type: LUNG: PAM dist: 18: indel length: 0: CRISPR gRNA ID: GF-CCELg9-285: [crRNA sequence]:
crRNA sequence: GGTGCCACGCCTAGAGACTCCGG (SEQ ID NO: 1620):
SpgRNA: attctaatacgactcactataggGGTGCCACGCCTAGAGACTCCgttttagagctagaaatagcaagttaaaataaggctagtccgtt
atcaacttgaaaaagtggcaccgagtcggtgc (SEQ ID NO: 1621): [Target gene information]: Gene ID: 2263: Symbol:
FGFR2: Ensembl Transcript ID: EN5T00000358487.5: GRCh: 37: Chr: 10: [Target cancer mutation
information]: mut start: 123325040: mut end: 123325040: mut class: Silent: mut type: SNP: ref seq: G: mut
seq: A: mut aa: p.G96G: mutation info source: CCLE: ref target(-10 +10): TAGGCGTGGCGCCCTTTATCT
(SEQ ID NO: 1622): mut target(-10 +10): TAGGCGTGGCACCCTTTATCT (SEQ ID NO: 1623): [Model
Cell line information]: cell: NCIH1563: cancer type: LUNG: PAM dist: 18: indel length: 0: CRISPR gRNA
ID: GF-CCELg9-286: [crRNA sequence]: crRNA sequence: TTTTTCTTCAGTGTATGACAAGG (SEQ ID
NO: 1624):
SpgRNA: attctaatacgactcactataggTTTTTCTTCAGTGTATGACAgttttagagctagaaatagcaagttaaaataaggctagtccgtta
tcaacttgaaaaagtggcaccgagtcggtgc (SEQ ID NO: 1625): [Target gene information]: Gene ID: 2271: Symbol:
FH: Ensembl Transcript ID: EN5T00000366560.3: GRCh: 37: Chr: 1: [Target cancer mutation information]:
mut start: 241661270: mut end: 241661270: mut class: Splice Site: mut type: SNP: ref seq: C: mut seq: A:
mut aa: p.G464V: mutation info source: CCLE: ref target(-10 +10): CTTGTCATACCCTGAAGAAAA (SEQ
ID NO: 429): mut target(-10 +10): CTTGTCATACACTGAAGAAAA (SEQ ID NO: 430): [Model Cell line
information]: cell: A549: cancer type: LUNG: PAM dist: 9: indel length: 0: CRISPR gRNA ID: GF-
CCELg9-287: [crRNA sequence]: crRNA sequence: TCCTCATTCACATCCCCTTGAGG (SEQ ID NO:
1626):
SpgRNA: attctaatacgactcactataggTCCTCATTCACATCCCCTTGg agagctagaaatagcaagttaaaataaggctagtccgtta
tcaacttgaaaaagtggcaccgagtcggtgc (SEQ ID NO: 1627): [Target gene information]: Gene ID: 201163:
Symbol: FLCN: Ensembl Transcript ID: EN5T00000285071.4: GRCh: 37: Chr: 17: [Target cancer mutation
information]: mut start: 17131351: mut end: 17131351: mut class: Missense Mutation: mut type: SNP: ref
seq: C: mut seq: A: mut aa: p.G34V: mutation info source: CCLE: ref target(-10 +10):
GTCCTCATTCCCATCCCCTTG (SEQ ID NO: 1628): mut target(-10 +10):
GTCCTCATTCACATCCCCTTG (SEQ ID NO: 1629): [Model Cell line information]: cell: NCIH661:
cancer type: LUNG: PAM dist: 11: indel length: 0: CRISPR gRNA ID: GF-CCELg9-288: [crRNA sequence]:
crRNA sequence: TTCACATCCCCTTGAGGAAGTGG (SEQ ID NO: 1630):

TABLE 7-continued

Illustrative guide RNA sequences for polypeptides comprising Cas9

SpgRNA: attctaatacgactcactataggTTCACATCCCCTTGAGGAAGgttttagagctagaaatagcaagttaaaataaggctagtccgtt
atcaacttgaaaaagtggcaccgagtcggtgc (SEQ ID NO: 1631): [Target gene information]: Gene ID: 201163:
Symbol: FLCN: Ensembl Transcript ID: EN5T00000285071.4: GRCh: 37: Chr: 17: [Target cancer mutation
information]: mut start: 17131351: mut end: 17131351: mut class: Missense Mutation: mut type: SNP: ref
seq: C: mut seq: A: mut aa: p.G34V: mutation info source: CCLE: ref target(-10 +10):
GTCCTCATTC<u>C</u>CATCCCCTTG (SEQ ID NO: 1628): mut target(-10 +10):
GTCCTCATTC<u>A</u>CATCCCCTTG (SEQ ID NO: 1629): [Model Cell line information]: cell: NCIH661:
cancer type: LUNG: PAM dist: 17: indel length: 0: CRISPR gRNA ID: GF-CCELg9-289: [crRNA sequence]:
crRNA sequence: TC<u>A</u>CATCCCCTTGAGGAAGTGGG (SEQ ID NO: 1632):
SpgRNA: attctaatacgactcactataggTCACATCCCCTTGAGGAAGTgttttagagctagaaatagcaagttaaaataaggctagtccgtt
atcaacttgaaaaagtggcaccgagtcggtgc (SEQ ID NO: 1633): [Target gene information]: Gene ID: 201163:
Symbol: FLCN: Ensembl Transcript ID: ENST00000285071.4: GRCh: 37: Chr: 17: [Target cancer mutation
information]: mut start: 17131351: mut end: 17131351: mut class: Missense Mutation: mut type: SNP: ref
seq: C: mut seq: A: mut aa: p.G34V: mutation info source: CCLE: ref target(-10 +10):
GTCCTCATTC<u>C</u>CATCCCCTTG (SEQ ID NO: 1628): mut target(-10 +10):
GTCCTCATTC<u>A</u>CATCCCCTTG (SEQ ID NO: 1629): [Model Cell line information]: cell: NCIH661:
cancer type: LUNG: PAM dist: 18: indel length: 0: CRISPR gRNA ID: GF-CCELg9-290: [crRNA sequence]:
crRNA sequence: C<u>A</u>CATCCCCTTGAGGAAGTGGGG (SEQ ID NO: 1634):
SpgRNA: attctaatacgactcactataggCACATCCCCTTGAGGAAGTGgttttagagctagaaatagcaagttaaaataaggctagtccgtt
atcaacttgaaaaagtggcaccgagtcggtgc (SEQ ID NO: 1635): [Target gene information]: Gene ID: 201163:
Symbol: FLCN: Ensembl Transcript ID: EN5T00000285071.4: GRCh: 37: Chr: 17: [Target cancer mutation
information]: mut start: 17131351: mut end: 17131351: mut class: Missense Mutation: mut type: SNP: ref
seq: C: mut seq: A: mut aa: p.G34V: mutation info source: CCLE: ref target(-10 +10):
GTCCTCATTC<u>C</u>CATCCCCTTG (SEQ ID NO: 1628): mut target(-10 +10):
GTCCTCATTC<u>A</u>CATCCCCTTG (SEQ ID NO: 1629): [Model Cell line information]: cell: NCIH661:
cancer type: LUNG: PAM dist: 19: indel length: 0: CRISPR gRNA ID: GF-CCELg9-291: [crRNA sequence]:
crRNA sequence: TCCTCAAGGGGATG<u>T</u>GAATGAGG (SEQ ID NO: 1636):
SpgRNA: attctaatacgactcactataggTCCTCAAGGGGATGTGAATGgttttagagctagaaatagcaagttaaaataaggctagtccgtt
atcaacttgaaaaagtggcaccgagtcggtgc (SEQ ID NO: 1637): [Target gene information]: Gene ID: 201163:
Symbol: FLCN: Ensembl Transcript ID: EN5T00000285071.4: GRCh: 37: Chr: 17: [Target cancer mutation
information]: mut start: 17131351: mut end: 17131351: mut class: Missense Mutation: mut type: SNP: ref
seq: C: mut seq: A: mut aa: p.G34V: mutation info source: CCLE: ref target(-10 +10):
GTCCTCATTC<u>C</u>CATCCCCTTG (SEQ ID NO: 1628): mut target(-10 +10):
GTCCTCATTC<u>A</u>CATCCCCTTG (SEQ ID NO: 1629): [Model Cell line information]: cell: NCIH661:
cancer type: LUNG: PAM dist: 6: indel length: 0: CRISPR gRNA ID: GF-CCELg9-292: [crRNA sequence]:
crRNA sequence: GATG<u>T</u>GAATGAGGACAGTCCTGG (SEQ ID NO: 1638):
SpgRNA: attctaatacgactcactataggGATGTGAATGAGGACAGTCCgttttagagctagaaatagcaagttaaaataaggctagtccgt
tatcaacttgaaaaagtggcaccgagtcggtgc (SEQ ID NO: 1639): [Target gene information]: Gene ID: 201163:
Symbol: FLCN: Ensembl Transcript ID: EN5T00000285071.4: GRCh: 37: Chr: 17: [Target cancer mutation
information]: mut start: 17131351: mut end: 17131351: mut class: Missense Mutation: mut type: SNP: ref
seq: C: mut seq: A: mut aa: p.G34V: mutation info source: CCLE: ref target(-10 +10):
GTCCTCATTC<u>C</u>CATCCCCTTG (SEQ ID NO: 1628): mut target(-10 +10):
GTCCTCATTC<u>A</u>CATCCCCTTG (SEQ ID NO: 1629): [Model Cell line information]: cell: NCIH661:
cancer type: LUNG: PAM dist: 16: indel length: 0: CRISPR gRNA ID: GF-CCELg9-293: [crRNA sequence]:
crRNA sequence: CAGCTTCT<u>A</u>TGTGTCCTCTTTGG (SEQ ID NO: 1640):
SpgRNA: attctaatacgactcactataggCAGCTTCTATGTGTCCTCTTgttttagagctagaaatagcaagttaaaataaggctagtccgtta
tcaacttgaaaaagtggcaccgagtcggtgc (SEQ ID NO: 1641): [Target gene information]: Gene ID: 201163:
Symbol: FLCN: Ensembl Transcript ID: ENST00000285071.4: GRCh: 37: Chr: 17: [Target cancer mutation
information]: mut start: 17117112: mut end: 17117112: mut class: Nonsense Mutation: mut type: SNP: ref
seq: G: mut seq: A: mut aa: p.Q533*: mutation info source: CCLE: ref target(-10 +10):
AGCAGCTTCT<u>G</u>TGTGTCCTCT (SEQ ID NO: 1642): mut target(-10 +10):
AGCAGCTTCT<u>A</u>TGTGTCCTCT (SEQ ID NO: 1643): [Model Cell line information]: cell: 5W1990:
cancer type: PANCREAS: PAM dist: 12: indel length: 0: CRISPR gRNA ID: GF-CCELg9-294: [crRNA
sequence]: crRNA sequence: AGCTTCT<u>A</u>TGTGTCCTCTTTGGG (SEQ ID NO: 1644):
SpgRNA: attctaatacgactcactataggAGCTTCTATGTGTCCTCTTTgttttagagctagaaatagcaagttaaaataaggctagtccgttat
caacttgaaaaagtggcaccgagtcggtgc (SEQ ID NO: 1645): [Target gene information]: Gene ID: 201163: Symbol:
FLCN: Ensembl Transcript ID: EN5T00000285071.4: GRCh: 37: Chr: 17: [Target cancer mutation
information]: mut start: 17117112: mut end: 17117112: mut class: Nonsense Mutation: mut type: SNP: ref
seq: G: mut seq: A: mut aa: p.Q533*: mutation info source: CCLE: ref target(-10 +10):
AGCAGCTTCT<u>G</u>TGTGTCCTCT (SEQ ID NO: 1642): mut target(-10 +10):
AGCAGCTTCT<u>A</u>TGTGTCCTCT (SEQ ID NO: 1643): [Model Cell line information]: cell: 5W1990:
cancer type: PANCREAS: PAM dist: 13: indel length: 0: CRISPR gRNA ID: GF-CCELg9-295: [crRNA
sequence]: crRNA sequence: <u>A</u>TAGAAGCTGCTGAGCATCCTGG (SEQ ID NO: 1646):
SpgRNA: attctaatacgactcactataggATAGAAGCTGCTGAGCATCCgttttagagctagaaatagcaagttaaaataaggctagtccgtt
atcaacttgaaaaagtggcaccgagtcggtgc (SEQ ID NO: 1647): [Target gene information]: Gene ID: 201163:
Symbol: FLCN: Ensembl Transcript ID: EN5T00000285071.4: GRCh: 37: Chr: 17: [Target cancer mutation
information]: mut start: 17117112: mut end: 17117112: mut class: Nonsense Mutation: mut type: SNP: ref
seq: G: mut seq: A: mut aa: p.Q533*: mutation info source: CCLE: ref target(-10 +10):
AGCAGCTTCT<u>G</u>TGTGTCCTCT (SEQ ID NO: 1642): mut target(-10 +10):
AGCAGCTTCT<u>A</u>TGTGTCCTCT (SEQ ID NO: 1643): [Model Cell line information]: cell: 5W1990:
cancer type: PANCREAS: PAM dist: 19: indel length: 0: CRISPR gRNA ID: GF-CCELg9-296: [crRNA
sequence]: crRNA sequence: <u>T</u>AGAAGCTGCTGAGCATCCTGGG (SEQ ID NO: 1648):
SpgRNA: attctaatacgactcactataggTAGAAGCTGCTGAGCATCCTgttttagagctagaaatagcaagttaaaataaggctagtccgtt
atcaacttgaaaaagtggcaccgagtcggtgc (SEQ ID NO: 1649): [Target gene information]: Gene ID: 201163:
Symbol: FLCN: Ensembl Transcript ID: EN5T00000285071.4: GRCh: 37: Chr: 17: [Target cancer mutation
information]: mut start: 17117112: mut end: 17117112: mut class: Nonsense Mutation: mut type: SNP: ref
seq: G: mut seq: A: mut aa: p.Q533*: mutation info source: CCLE: ref target(-10 +10):
AGCAGCTTCT<u>G</u>TGTGTCCTCT (SEQ ID NO: 1642): mut target(-10 +10):

TABLE 7-continued

Illustrative guide RNA sequences for polypeptides comprising Cas9

AGCAGCTTCTATGTGTCCTCT (SEQ ID NO: 1643): [Model Cell line information]: cell: SW1990: cancer type: PANCREAS: PAM dist: 20: indel length: 0: CRISPR gRNA ID: GF-CCELg9-297: [crRNA sequence]: crRNA sequence: ACTTTTATCTTCTTGAAAGCCGG (SEQ ID NO: 1650): SpgRNA: attctaatacgactcactataggACTTTTATCTTCTTGAAAGCgttttagagctagaaatagcaagttaaaataaggctagtccgtta tcaacttgaaaaagtggcaccgagtcggtgc (SEQ ID NO: 1651): [Target gene information]: Gene ID: 2321: Symbol: FLT1: Ensembl Transcript ID: EN5T00000282397.4: GRCh: 37: Chr: 13: [Target cancer mutation information]: mut start: 28896964: mut end: 28896964: mut class: Silent: mut type: SNP: ref seq: C: mut seq: T: mut aa: p.Q972Q: mutation info source: CCLE: ref target(-10 +10): TTTTATCTTCCTGAAAGCCGG (SEQ ID NO: 447): mut target(-10 +10): TTTTATCTTCTTGAAAGCCGG (SEQ ID NO: 448): [Model Cell line information]: cell: NCIH1573: cancer type: LUNG: PAM dist: 8: indel length: 0: CRISPR gRNA ID: GF-CCELg9-298: [crRNA sequence]: crRNA sequence: TCAGTGGCAAGAAAAGACACCGG (SEQ ID NO: 1652): SpgRNA: attctaatacgactcactataggTCAGTGGCAAGAAAAGACACg agagctagaaatagcaagttaaaataaggctagtccgt tatcaacttgaaaaagtggcaccgagtcggtgc (SEQ ID NO: 1653): [Target gene information]: Gene ID: 2322: Symbol: FLT3: Ensembl Transcript ID: EN5T00000241453.7: GRCh: 37: Chr: 13: [Target cancer mutation information]: mut start: 28623588: mut end: 28623588: mut class: Missense Mutation: mut type: SNP: ref seq: G: mut seq: T: mut aa: p.N323K: mutation info source: CCLE: ref target(-10 +10): ATCCGGTGTCGTTTCTTGCCA (SEQ ID NO: 457): mut target(-10 +10): ATCCGGTGTCTTTTCTTGCCA (SEQ ID NO: 458): [Model Cell line information]: cell: A549: cancer type: LUNG: PAM dist: 6: indel length: 0: CRISPR gRNA ID: GF-CCELg9-299: [crRNA sequence]: crRNA sequence: TGCTTTTCCATCCTTGTACCTGG (SEQ ID NO: 1654): SpgRNA: attctaatacgactcactataggTGCTTTTCCATCCTTGTACCgttttagagctagaaatagcaagttaaaataaggctagtccgttat caacttgaaaaagtggcaccgagtcggtgc (SEQ ID NO: 1655): [Target gene information]: Gene ID: 2324: Symbol: FLT4: Ensembl Transcript ID: EN5T00000261937.6: GRCh: 37: Chr: 5: [Target cancer mutation information]: mut start: 180053250: mut end: 180053250: mut class: Silent: mut type: SNP: ref seq: C: mut seq: T: mut aa: p.K373K: mutation info source: CCLE: ref target(-10 +10): CGGACAGTGCCTTTCCATCCT (SEQ ID NO: 465): mut target(-10 +10): CGGACAGTGCTTTTCCATCCT (SEQ ID NO: 466): [Model Cell line information]: cell: NCIH661: cancer type: LUNG: PAM dist: 17: indel length: 0: CRISPR gRNA ID: GF-CCELg9-300: [crRNA sequence]: crRNA sequence: AAGGATGGAAAAGCACTGTCCGG (SEQ ID NO: 1656): SpgRNA: attctaatacgactcactataggAAGGATGGAAAAGCACTGTCgttttagagctagaaatagcaagttaaaataaggctagtccgt tatcaacttgaaaaagtggcaccgagtcggtgc (SEQ ID NO: 1657): [Target gene information]: Gene ID: 2324: Symbol: FLT4: Ensembl Transcript ID: ENST00000261937.6: GRCh: 37: Chr: 5: [Target cancer mutation information]: mut start: 180053250: mut end: 180053250: mut class: Silent: mut type: SNP: ref seq: C: mut seq: T: mut aa: p.K373K: mutation info source: CCLE: ref target(-10 +10): CGGACAGTGCCTTTCCATCCT (SEQ ID NO: 465): mut target(-10 +10): CGGACAGTGCTTTTCCATCCT (SEQ ID NO: 466): [Model Cell line information]: cell: NCIH661: cancer type: LUNG: PAM dist: 9: indel length: 0: CRISPR gRNA ID: GF-CCELg9-301: [crRNA sequence]: crRNA sequence: AGGATGGAAAAGCACTGTCCGGG (SEQ ID NO: 1658): SpgRNA: attctaatacgactcactataggAGGATGGAAAAGCACTGTCCgttttagagctagaaatagcaagttaaaataaggctagtccgt tatcaacttgaaaaagtggcaccgagtcggtgc (SEQ ID NO: 1659): [Target gene information]: Gene ID: 2324: Symbol: FLT4: Ensembl Transcript ID: EN5T00000261937.6: GRCh: 37: Chr: 5: [Target cancer mutation information]: mut start: 180053250: mut end: 180053250: mut class: Silent: mut type: SNP: ref seq: C: mut seq: T: mut aa: p.K373K: mutation info source: CCLE: ref target(-10 +10): CGGACAGTGCCTTTCCATCCT (SEQ ID NO: 465): mut target(-10 +10): CGGACAGTGCTTTTCCATCCT (SEQ ID NO: 466): [Model Cell line information]: cell: NCIH661: cancer type: LUNG: PAM dist: 10: indel length: 0: CRISPR gRNA ID: GF-CCELg9-302: [crRNA sequence]: crRNA sequence: GGGGTGCTGCGCATTCATCACGG (SEQ ID NO: 1660): SpgRNA: attctaatacgactcactataggGGGGTGCTGCGCATTCATCgttttagagctagaaatagcaagttaaaataaggctagtccgtt atcaacttgaaaaagtggcaccgagtcggtgc (SEQ ID NO: 1661): [Target gene information]: Gene ID: 2624: Symbol: GATA2: Ensembl Transcript ID: ENST00000341105.2: GRCh: 37: Chr: 3: [Target cancer mutation information]: mut start: 128205826: mut end: 128205826: mut class: Missense Mutation: mut type: SNP: ref seq: G: mut seq: T: mut aa: p.L17M: mutation info source: CCLE: ref target(-10 +10): TGCGCATTCAGCACGGCCGGG (SEQ ID NO: 1662): mut target(-10 +10): TGCGCATTCATCACGGCCGGG (SEQ ID NO: 1663): [Model Cell line information]: cell: NCIH2126: cancer type: LUNG: PAM dist: 3: indel length: 0: CRISPR gRNA ID: GF-CCELg9-303: [crRNA sequence]: crRNA sequence: TGCTGCGCATTCATCACGGCCGG (SEQ ID NO: 1664): SpgRNA: attctaatacgactcactataggTGCTGCGCATTCATCACGGCgttttagagctagaaatagcaagttaaaataaggctagtccgtt atcaacttgaaaaagtggcaccgagtcggtgc (SEQ ID NO: 1665): [Target gene information]: Gene ID: 2624: Symbol: GATA2: Ensembl Transcript ID: ENST00000341105.2: GRCh: 37: Chr: 3: [Target cancer mutation information]: mut start: 128205826: mut end: 128205826: mut class: Missense Mutation: mut type: SNP: ref seq: G: mut seq: T: mut aa: p.L17M: mutation info source: CCLE: ref target(-10 +10): TGCGCATTCAGCACGGCCGGG (SEQ ID NO: 1662): mut target(-10 +10): TGCGCATTCATCACGGCCGGG (SEQ ID NO: 1663): [Model Cell line information]: cell: NCIH2126: cancer type: LUNG: PAM dist: 7: indel length: 0: CRISPR gRNA ID: GF-CCELg9-304: [crRNA sequence]: crRNA sequence: GCTGCGCATTCATCACGGCCGGG (SEQ ID NO: 1666): SpgRNA: attctaatacgactcactataggGCTGCGCATTCATCACGGCCgttttagagctagaaatagcaagttaaaataaggctagtccgtt atcaacttgaaaaagtggcaccgagtcggtgc (SEQ ID NO: 1667): [Target gene information]: Gene ID: 2624: Symbol: GATA2: Ensembl Transcript ID: ENST00000341105.2: GRCh: 37: Chr: 3: [Target cancer mutation information]: mut start: 128205826: mut end: 128205826: mut class: Missense Mutation: mut type: SNP: ref seq: G: mut seq: T: mut aa: p.L17M: mutation info source: CCLE: ref target(-10 +10): TGCGCATTCAGCACGGCCGGG (SEQ ID NO: 1662): mut target(-10 +10): TGCGCATTCATCACGGCCGGG (SEQ ID NO: 1663): [Model Cell line information]: cell: NCIH2126: cancer type: LUNG: PAM dist: 8: indel length: 0: CRISPR gRNA ID: GF-CCELg9-305: [crRNA sequence]: crRNA sequence: AAGCTTGTAGTACAGCCCACAGG (SEQ ID NO: 1668):

TABLE 7-continued

Illustrative guide RNA sequences for polypeptides comprising Cas9

SpgRNA: attctaatacgactcactataggAAGCTTGTAGTACAGCCCACgttttagagctagaaatagcaagttaaaataaggctagtccgtt
atcaacttgaaaaagtggcaccgagtcggtgc (SEQ ID NO: 1669): [Target gene information]: Gene ID: 2625: Symbol:
GATA3: Ensembl Transcript ID: EN5T00000346208.3: GRCh: 37: Chr: 10: [Target cancer mutation
informa-
tion]: mut start: 8111543: mut end: 8111543: mut class: Silent: mut type: SNP: ref seq: C: mut seq:
G: mut aa: p.L343L: mutation info source: CCLE: ref target(-10 +10): CCTGTGGGCTCTACTACAAGC
(SEQ ID NO: 1670): mut target(-10 +10): CCTGTGGGCTGTACTACAAGC (SEQ ID NO: 1671): [Model
Cell line information]: cell: NCIH1573: cancer type: LUNG: PAM dist: 8: indel length: 0: CRISPR gRNA
ID: GF-CCELg9-306: [crRNA sequence]: crRNA sequence: AGTTGAACACGGCGTCTCAGAGG (SEQ ID
NO: 1672):
SpgRNA: attctaatacgactcactataggAGTTGAACACGGCGTCTCAGgttttagagctagaaatagcaagttaaaataaggctagtccgtt
atcaacttgaaaaagtggcaccgagtcggtgc (SEQ ID NO: 1673): [Target gene information]: Gene ID: 2735: Symbol:
Gill: Ensembl Transcript ID: EN5T00000228682.2: GRCh: 37: Chr: 12: [Target cancer mutation
information]: mut start: 57857475: mut end: 57857475: mut class: Start Codon SNP: mut type: SNP: ref seq:
A: mut seq: G: mut aa: p.M1V: mutation info source: CCLE: ref target(-10 +10):
CTGAGACGCCATGTTCAACTC (SEQ ID NO: 1674): mut target(-10 +10):
CTGAGACGCCGTGTTCAACTC (SEQ ID NO: 1675): [Model Cell line information]: cell: NCIH1975:
cancer type: LUNG: PAM dist: 11: indel length: 0: CRISPR gRNA ID: GF-CCELg9-307: [crRNA sequence]:
crRNA sequence: TGAACACGGCGTCTCAGAGGAGG (SEQ ID NO: 1676):
SpgRNA: attctaatacgactcactataggTGAACACGGCGTCTCAGAGGgttttagagctagaaatagcaagttaaaataaggctagtccgt
tatcaacttgaaaaagtggcaccgagtcggtgc (SEQ ID NO: 1677): [Target gene information]: Gene ID: 2735: Symbol:
Gill: Ensembl Transcript ID: ENST00000228682.2: GRCh: 37: Chr: 12: [Target cancer mutation
information]: mut start: 57857475: mut end: 57857475: mut class: Start Codon SNP: mut type: SNP: ref seq:
A: mut seq: G: mut aa: p.M1V: mutation info source: CCLE: ref target(-10 +10):
CTGAGACGCCATGTTCAACTC (SEQ ID NO: 1674): mut target(-10 +10):
CTGAGACGCCGTGTTCAACTC (SEQ ID NO: 1675): [Model Cell line information]: cell: NCIH1975:
cancer type: LUNG: PAM dist: 14: indel length: 0: CRISPR gRNA ID: GF-CCELg9-308: [crRNA sequence]:
crRNA sequence: CGGCGTCTCAGAGGAGGGTGTGG (SEQ ID NO: 1678):
SpgRNA: attctaatacgactcactataggCGGCGTCTCAGAGGAGGGTGgttttagagctagaaatagcaagttaaaataaggctagtccgt
tatcaacttgaaaaagtggcaccgagtcggtgc (SEQ ID NO: 1679): [Target gene information]: Gene ID: 2735: Symbol:
Gill: Ensembl Transcript ID: EN5T00000228682.2: GRCh: 37: Chr: 12: [Target cancer mutation
information]: mut start: 57857475: mut end: 57857475: mut class: Start Codon SNP: mut type: SNP: ref seq:
A: mut seq: G: mut aa: p.M1V: mutation info source: CCLE: ref target(-10 +10):
CTGAGACGCCATGTTCAACTC (SEQ ID NO: 1674): mut target(-10 +10):
CTGAGACGCCGTGTTCAACTC (SEQ ID NO: 1675): [Model Cell line information]: cell: NCIH1975:
cancer type: LUNG: PAM dist: 20: indel length: 0: CRISPR gRNA ID: GF-CCELg9-309: [crRNA sequence]:
crRNA sequence: TGGGGTCATCGAGTTGAACACGG (SEQ ID NO: 1680):
SpgRNA: attctaatacgactcactataggTGGGGTCATCGAGTTGAACAgttttagagctagaaatagcaagttaaaataaggctagtccgtt
atcaacttgaaaaagtggcaccgagtcggtgc (SEQ ID NO: 1681): [Target gene information]: Gene ID: 2735: Symbol:
Gill: Ensembl Transcript ID: EN5T00000228682.2: GRCh: 37: Chr: 12: [Target cancer mutation
information]: mut start: 57857475: mut end: 57857475: mut class: Start Codon SNP: mut type: SNP: ref seq:
A: mut seq: G: mut aa: p.M1V: mutation info source: CCLE: ref target(-10 +10):
CTGAGACGCCATGTTCAACTC (SEQ ID NO: 1674): mut target(-10 +10):
CTGAGACGCCGTGTTCAACTC (SEQ ID NO: 1675): [Model Cell line information]: cell: NCIH1975:
cancer type: LUNG: PAM dist: 0: indel length: 0: CRISPR gRNA ID: GF-CCELg9-310: [crRNA sequence]:
crRNA sequence: GAACACGGCGTCTCAGAGGAGGG (SEQ ID NO: 1682):
SpgRNA: attctaatacgactcactataggGAACACGGCGTCTCAGAGGAgttttagagctagaaatagcaagttaaaataaggctagtccgt
tatcaacttgaaaaagtggcaccgagtcggtgc (SEQ ID NO: 1683): [Target gene information]: Gene ID: 2735: Symbol:
Gill: Ensembl Transcript ID: EN5T00000228682.2: GRCh: 37: Chr: 12: [Target cancer mutation
information]: mut start: 57857475: mut end: 57857475: mut class: Start Codon SNP: mut type: SNP: ref seq:
A: mut seq: G: mut aa: p.M1V: mutation info source: CCLE: ref target(-10 +10):
CTGAGACGCCATGTTCAACTC (SEQ ID NO: 1674): mut target(-10 +10):
CTGAGACGCCGTGTTCAACTC (SEQ ID NO: 1675): [Model Cell line information]: cell: NCIH1975:
cancer type: LUNG: PAM dist: 15: indel length: 0: CRISPR gRNA ID: GF-CCELg9-311: [crRNA sequence]:
crRNA sequence: AGCCCCTGGATGAAGATCTCCGG (SEQ ID NO: 1684):
SpgRNA: attctaatacgactcactataggAGCCCCTGGATGAAGATCTCCGGgttttagagctagaaatagcaagttaaaataaggctagtccgtt
atcaacttgaaaaagtggcaccgagtcggtgc (SEQ ID NO: 1685): [Target gene information]: Gene ID: 2778: Symbol:
GNAS: Ensembl Transcript ID: ENST00000306120.3: GRCh: 37: Chr: 20: [Target cancer mutation
information]: mut start: 57429227: mut end: 57429227: mut class: Nonsense Mutation: mut type: SNP: ref
seq: G: mut seq: A: mut aa: p.W239*: mutation info source: CCLE: ref target(-10 +10):
CCCCTGGATGGAGATCTCCGG (SEQ ID NO: 1686): mut target(-10 +10):
CCCCTGGATGAAGATCTCCGG (SEQ ID NO: 1687): [Model Cell line information]: cell: NCIH661:
cancer type: LUNG: PAM dist: 8: indel length: 0: CRISPR gRNA ID: GF-CCELg9-312: [crRNA sequence]:
crRNA sequence: GGGTCCGGAGATCTTCATCCAGG (SEQ ID NO: 1688):
SpgRNA: attctaatacgactcactataggGGGTCCGGAGATCTTCATCCgttttagagctagaaatagcaagttaaaataaggctagtccgtt
atcaacttgaaaaagtggcaccgagtcggtgc (SEQ ID NO: 1689): [Target gene information]: Gene ID: 2778: Symbol:
GNAS: Ensembl Transcript ID: ENST00000306120.3: GRCh: 37: Chr: 20: [Target cancer mutation
information]: mut start: 57429227: mut end: 57429227: mut class: Nonsense Mutation: mut type: SNP: ref
seq: G: mut seq: A: mut aa: p.W239*: mutation info source: CCLE: ref target(-10 +10):
CCCCTGGATGGAGATCTCCGG (SEQ ID NO: 1686): mut target(-10 +10):
CCCCTGGATGAAGATCTCCGG (SEQ ID NO: 1687): [Model Cell line information]: cell: NCIH661:
cancer type: LUNG: PAM dist: 6: indel length: 0: CRISPR gRNA ID: GF-CCELg9-313: [crRNA sequence]:
crRNA sequence: GGTCCGGAGATCTTCATCCAGGG (SEQ ID NO: 1690):
SpgRNA: attctaatacgactcactataggGGTCCGGAGATCTTCATCCAgttttagagctagaaatagcaagttaaaataaggctagtccgtt
atcaacttgaaaaagtggcaccgagtcggtgc (SEQ ID NO: 1691): [Target gene information]: Gene ID: 2778: Symbol:
GNAS: Ensembl Transcript ID: ENST00000306120.3: GRCh: 37: Chr: 20: [Target cancer mutation
information]: mut start: 57429227: mut end: 57429227: mut class: Nonsense Mutation: mut type: SNP: ref
seq: G: mut seq: A: mut aa: p.W239*: mutation info source: CCLE: ref target(-10 +10):

TABLE 7-continued

Illustrative guide RNA sequences for polypeptides comprising Cas9

CCCCTGGATGG*A*GATCTCCGG (SEQ ID NO: 1686): mut target(-10 +10):
CCCCTGGATGA*A*GATCTCCGG (SEQ ID NO: 1687): [Model Cell line information]: cell: NCIH661:
cancer type: LUNG: PAM dist: 7: indel length: 0: CRISPR gRNA ID: GF-CCELg9-314: [crRNA sequence]:
crRNA sequence: GTCCGGAGATCT*T*CATCCAGGGG (SEQ ID NO: 1692):
SpgRNA: attctaatacgactcactataggGTCCGGAGATCTTCATCCAGgttttagagctagaaatagcaagttaaaataaggctagtccgtt
atcaacttgaaaaagtggcaccgagtcggtgc (SEQ ID NO: 1693): [Target gene information]: Gene ID: 2778: Symbol:
GNAS: Ensembl Transcript ID: ENST00000306120.3: GRCh: 37: Chr: 20: [Target cancer mutation
information]: mut start: 57429227: mut end: 57429227: mut class: Nonsense Mutation: mut type: SNP: ref
seq: G: mut seq: A: mut aa: p.W239*: mutation info source: CCLE: ref target(-10 +10):
CCCCTGGATGG*A*GATCTCCGG (SEQ ID NO: 1686): mut target(-10 +10):
CCCCTGGATGA*A*GATCTCCGG (SEQ ID NO: 1687): [Model Cell line information]: cell: NCIH661:
cancer type: LUNG: PAM dist: 8: indel length: 0: CRISPR gRNA ID: GF-CCELg9-315: [crRNA sequence]:
crRNA sequence: GGTCCCCGGAGCTCCTCCT*G*AGG (SEQ ID NO: 1694):
SpgRNA: attctaatacgactcactataggGGTCCCCGGAGCTCCTCCTGgttttagagctagaaatagcaagttaaaataaggctagtccgtt
atcaacttgaaaaagtggcaccgagtcggtgc (SEQ ID NO: 1695): [Target gene information]: Gene ID: 2778: Symbol:
GNAS: Ensembl Transcript ID: ENST00000306120.3: GRCh: 37: Chr: 20: [Target cancer mutation
information]: mut start: 57428917: mut end: 57428917: mut class: Missense Mutation: mut type: SNP: ref
seq: C: mut seq: T: mut aa: p.P136L: mutation info source: CCLE: ref target(-10 +10):
GAGCTCCTCC*C*GAGGAGCCCC (SEQ ID NO: 1696): mut target(-10 +10):
GAGCTCCTCC*T*GAGGAGCCCC (SEQ ID NO: 1697): [Model Cell line information]: cell: NCIH1573:
cancer type: LUNG: PAM dist: 2: indel length: 0: CRISPR gRNA ID: GF-CCELg9-316: [crRNA sequence]:
crRNA sequence: CT*G*AGGAGCCCCAAGCCCTCAGG (SEQ ID NO: 1698):
SpgRNA: attctaatacgactcactataggCTGAGGAGCCCCAAGCCCTCgttttagagctagaaatagcaagttaaaataaggctagtccgtt
atcaacttgaaaaagtggcaccgagtcggtgc (SEQ ID NO: 1699): [Target gene information]: Gene ID: 2778: Symbol:
GNAS: Ensembl Transcript ID: ENST00000306120.3: GRCh: 37: Chr: 20: [Target cancer mutation
information]: mut start: 57428917: mut end: 57428917: mut class: Missense Mutation: mut type: SNP: ref
seq: C: mut seq: T: mut aa: p.P136L: mutation info source: CCLE: ref target(-10 +10):
GAGCTCCTCC*C*GAGGAGCCCC (SEQ ID NO: 1696): mut target(-10 +10):
GAGCTCCTCC*T*GAGGAGCCCC (SEQ ID NO: 1697): [Model Cell line information]: cell: NCIH1573:
cancer type: LUNG: PAM dist: 19: indel length: 0: CRISPR gRNA ID: GF-CCELg9-317: [crRNA sequence]:
crRNA sequence: CTGAGGGCTTGGGGCTCCCTC*A*GG (SEQ ID NO: 1700):
SpgRNA: attctaatacgactcactataggCTGAGGGCTTGGGGCTCCCTCgttttagagctagaaatagcaagttaaaataaggctagtccgtt
atcaacttgaaaaagtggcaccgagtcggtgc (SEQ ID NO: 1701): [Target gene information]: Gene ID: 2778: Symbol:
GNAS: Ensembl Transcript ID: ENST00000306120.3: GRCh: 37: Chr: 20: [Target cancer mutation
information]: mut start: 57428917: mut end: 57428917: mut class: Missense Mutation: mut type: SNP: ref
seq: C: mut seq: T: mut aa: p.P136L: mutation info source: CCLE: ref target(-10 +10):
GAGCTCCTCC*C*GAGGAGCCCC (SEQ ID NO: 1696): mut target(-10 +10):
GAGCTCCTCC*T*GAGGAGCCCC (SEQ ID NO: 1697): [Model Cell line information]: cell: NCIH1573:
cancer type: LUNG: PAM dist: 0: indel length: 0: CRISPR gRNA ID: GF-CCELg9-318: [crRNA sequence]:
crRNA sequence: AGGGCTTGGGGCTCCTC*A*GGAGG (SEQ ID NO: 1702):
SpgRNA: attctaatacgactcactataggAGGGCTTGGGGCTCCTCAGGgttttagagctagaaatagcaagttaaaataaggctagtccgtt
atcaacttgaaaaagtggcaccgagtcggtgc (SEQ ID NO: 1703): [Target gene information]: Gene ID: 2778: Symbol:
GNAS: Ensembl Transcript ID: ENST00000306120.3: GRCh: 37: Chr: 20: [Target cancer mutation
information]: mut start: 57428917: mut end: 57428917: mut class: Missense Mutation: mut type: SNP: ref
seq: C: mut seq: T: mut aa: p.P136L: mutation info source: CCLE: ref target(-10 +10):
GAGCTCCTCC*C*GAGGAGCCCC (SEQ ID NO: 1696): mut target(-10 +10):
GAGCTCCTCC*T*GAGGAGCCCC (SEQ ID NO: 1697): [Model Cell line information]: cell: NCIH1573:
cancer type: LUNG: PAM dist: 3: indel length: 0: CRISPR gRNA ID: GF-CCELg9-319: [crRNA sequence]:
crRNA sequence: GGGCTCCTC*A*GGAGGAGCTCCGG (SEQ ID NO: 1704):
SpgRNA: attctaatacgactcactataggGGGCTCCTCAGGAGGAGCTCgttttagagctagaaatagcaagttaaaataaggctagtccgtt
atcaacttgaaaaagtggcaccgagtcggtgc (SEQ ID NO: 1705): [Target gene information]: Gene ID: 2778: Symbol:
GNAS: Ensembl Transcript ID: ENST00000306120.3: GRCh: 37: Chr: 20: [Target cancer mutation
information]: mut start: 57428917: mut end: 57428917: mut class: Missense Mutation: mut type: SNP: ref
seq: C: mut seq: T: mut aa: p.P136L: mutation info source: CCLE: ref target(-10 +10):
GAGCTCCTCC*C*GAGGAGCCCC (SEQ ID NO: 1696): mut target(-10 +10):
GAGCTCCTCC*T*GAGGAGCCCC (SEQ ID NO: 1697): [Model Cell line information]: cell: NCIH1573:
cancer type: LUNG: PAM dist: 11: indel length: 0: CRISPR gRNA ID: GF-CCELg9-320: [crRNA sequence]:
crRNA sequence: GGCTCCTC*A*GGAGGAGCTCCGGG (SEQ ID NO: 1706):
SpgRNA: attctaatacgactcactataggGGCTCCTCAGGAGGAGCTCCgttttagagctagaaatagcaagttaaaataaggctagtccgtt
atcaacttgaaaaagtggcaccgagtcggtgc (SEQ ID NO: 1707): [Target gene information]: Gene ID: 2778: Symbol:
GNAS: Ensembl Transcript ID: ENST00000306120.3: GRCh: 37: Chr: 20: [Target cancer mutation
information]: mut start: 57428917: mut end: 57428917: mut class: Missense Mutation: mut type: SNP: ref
seq: C: mut seq: T: mut aa: p.P136L: mutation info source: CCLE: ref target(-10 +10):
GAGCTCCTCC*C*GAGGAGCCCC (SEQ ID NO: 1696): mut target(-10 +10):
GAGCTCCTCC*T*GAGGAGCCCC (SEQ ID NO: 1697): [Model Cell line information]: cell: NCIH1573:
cancer type: LUNG: PAM dist: 12: indel length: 0: CRISPR gRNA ID: GF-CCELg9-321: [crRNA sequence]:
crRNA sequence: GCTCCTC*A*GGAGGAGCTCCGGGG (SEQ ID NO: 1708):
SpgRNA: attctaatacgactcactataggGCTCCTCAGGAGGAGCTCCGgttttagagctagaaatagcaagttaaaataaggctagtccgtt
atcaacttgaaaaagtggcaccgagtcggtgc (SEQ ID NO: 1709): [Target gene information]: Gene ID: 2778: Symbol:
GNAS: Ensembl Transcript ID: ENST00000306120.3: GRCh: 37: Chr: 20: [Target cancer mutation
information]: mut start: 57428917: mut end: 57428917: mut class: Missense Mutation: mut type: SNP: ref
seq: C: mut seq: T: mut aa: p.P136L: mutation info source: CCLE: ref target(-10 +10):
GAGCTCCTCC*C*GAGGAGCCCC (SEQ ID NO: 1696): mut target(-10 +10):
GAGCTCCTCC*T*GAGGAGCCCC (SEQ ID NO: 1697): [Model Cell line information]: cell: NCIH1573:
cancer type: LUNG: PAM dist: 13: indel length: 0: CRISPR gRNA ID: GF-CCELg9-322: [crRNA sequence]:
crRNA sequence: AGCCCAGCTTGGGAGGCTT*A*TGG (SEQ ID NO: 1710):
SpgRNA: attctaatacgactcactataggAGCCCAGCTTGGGAGGCTTAgttttagagctagaaatagcaagttaaaataaggctagtccgtt
atcaacttgaaaaagtggcaccgagtcggtgc (SEQ ID NO: 1711): [Target gene information]: Gene ID: 2778: Symbol:

TABLE 7-continued

Illustrative guide RNA sequences for polypeptides comprising Cas9

GNAS: Ensembl Transcript ID: ENST00000371100.4: GRCh: 37: Chr: 20: [Target cancer mutation information]: mut start: 57428662: mut end: 57428662: mut class: Missense Mutation: mut type: SNP: ref seq: C: mut seq: A: mut aa: p.F114L: mutation info source: CCLE: ref target(-10 +10):
TGGGAGGCTTCTGGCCTACAC (SEQ ID NO: 1712): mut target(-10 +10):
TGGGAGGCTTATGGCCTACAC (SEQ ID NO: 1713): [Model Cell line information]: cell: NCIH2126: cancer type: LUNG: PAM dist: 1: indel length: 0: CRISPR gRNA ID: GF-CCELg9-323: [crRNA sequence]: crRNA sequence: GGGAGGCTTATGGCCTACACTGG (SEQ ID NO: 1714):
SpgRNA: attctaatacgactcactataggGGGAGGCTTATGGCCTACACgttttagagctagaaatagcaagttaaaataaggctagtccgtt atcaacttgaaaaagtggcaccgagtcggtgc (SEQ ID NO: 1715): [Target gene information]: Gene ID: 2778: Symbol: GNAS: Ensembl Transcript ID: ENST00000371100.4: GRCh: 37: Chr: 20: [Target cancer mutation information]: mut start: 57428662: mut end: 57428662: mut class: Missense Mutation: mut type: SNP: ref seq: C: mut seq: A: mut aa: p.F114L: mutation info source: CCLE: ref target(-10 +10):
TGGGAGGCTTCTGGCCTACAC (SEQ ID NO: 1712): mut target(-10 +10):
TGGGAGGCTTATGGCCTACAC (SEQ ID NO: 1713): [Model Cell line information]: cell: NCIH2126: cancer type: LUNG: PAM dist: 11: indel length: 0: CRISPR gRNA ID: GF-CCELg9-324: [crRNA sequence]: : crRNA sequence: AGGCCATAAGCCTCCCAAGCTGG (SEQ ID NO: 1716):
SpgRNA: attctaatacgactcactataggAGGCCATAAGCCTCCCAAGCgttttagagctagaaatagcaagttaaaataaggctagtccgtt atcaacttgaaaaagtggcaccgagtcggtgc (SEQ ID NO: 1717): [Target gene information]: Gene ID: 2778: Symbol: GNAS: Ensembl Transcript ID: ENST00000371100.4: GRCh: 37: Chr: 20: [Target cancer mutation information]: mut start: 57428662: mut end: 57428662: mut class: Missense Mutation: mut type: SNP: ref seq: C: mut seq: A: mut aa: p.F114L: mutation info source: CCLE: ref target(-10 +10):
TGGGAGGCTTCTGGCCTACAC (SEQ ID NO: 1712): mut target(-10 +10):
TGGGAGGCTTATGGCCTACAC (SEQ ID NO: 1713): [Model Cell line information]: cell: NCIH2126: cancer type: LUNG: PAM dist: 14: indel length: 0: CRISPR gRNA ID: GF-CCELg9-325: [crRNA sequence]: : crRNA sequence: GGCCATAAGCCTCCCAAGCTGGG (SEQ ID NO: 1718):
SpgRNA: attctaatacgactcactataggGGCCATAAGCCTCCCAAGCTgttttagagctagaaatagcaagttaaaataaggctagtccgtt atcaacttgaaaaagtggcaccgagtcggtgc (SEQ ID NO: 1719): [Target gene information]: Gene ID: 2778: Symbol: GNAS: Ensembl Transcript ID: ENST00000371100.4: GRCh: 37: Chr: 20: [Target cancer mutation information]: mut start: 57428662: mut end: 57428662: mut class: Missense Mutation: mut type: SNP: ref 276
seq: C: mut seq: A: mut aa: p.F114L: mutation info source: CCLE: ref target(-10 +10):
TGGGAGGCTTCTGGCCTACAC (SEQ ID NO: 1712): mut target(-10 +10):
TGGGAGGCTTATGGCCTACAC (SEQ ID NO: 1713): [Model Cell line information]: cell: NCIH2126: cancer type: LUNG: PAM dist: 15: indel length: 0: CRISPR gRNA ID: GF-CCELg9-326: [crRNA sequence] : crRNA sequence: ATCTCTTATGGAAGATACCTAGG (SEQ ID NO: 1720):
SpgRNA: attctaatacgactcactataggATCTCTTATGGAAGATACCTgttttagagctagaaatagcaagttaaaataaggctagtccgtt atcaacttgaaaaagtggcaccgagtcggtgc (SEQ ID NO: 1721): [Target gene information]: Gene ID: 2903: Symbol: GRIN2A: Ensembl Transcript ID: EN5T00000396573.2: GRCh: 37: Chr: 16: [Target cancer mutation information]: mut start: 9858241: mut end: 9858241: mut class: Nonsense Mutation: mut type: SNP: ref seq: C: mut seq: A: mut aa: p.E1054*: mutation info source: CCLE: ref target(-10 +10):
GCCATCTCTTCTGGAAGATAC (SEQ ID NO: 1722): mut target(-10 +10):
GCCATCTCTTATGGAAGATAC (SEQ ID NO: 1723): [Model Cell line information]: cell: NCIH1573: cancer type: LUNG: PAM dist: 13: indel length: 0: CRISPR gRNA ID: GF-CCELg9-327: [crRNA sequence]: crRNA sequence: TCAGAGTGGGCCATCTCTTATGG (SEQ ID NO: 1724):
SpgRNA: attctaatacgactcactataggTCAGAGTGGGCCATCTCTTAgttttagagctagaaatagcaagttaaaataaggctagtccgtt atcaacttgaaaaagtggcaccgagtcggtgc (SEQ ID NO: 1725): [Target gene information]: Gene ID: 2903: Symbol: GRIN2A: Ensembl Transcript ID: EN5T00000396573.2: GRCh: 37: Chr: 16: [Target cancer mutation information]: mut start: 9858241: mut end: 9858241: mut class: Nonsense Mutation: mut type: SNP: ref seq: C: mut seq: A: mut aa: p.E1054*: mutation info source: CCLE: ref target(-10 +10):
GCCATCTCTTCTGGAAGATAC (SEQ ID NO: 1722): mut target(-10 +10):
GCCATCTCTTATGGAAGATAC (SEQ ID NO: 1723): [Model Cell line information]: cell: NCIH1573: cancer type: LUNG: PAM dist: 1: indel length: 0: CRISPR gRNA ID: GF-CCELg9-328: [crRNA sequence]: crRNA sequence: TCTCTTATGGAAGATACCTAGGG (SEQ ID NO: 1726):
SpgRNA: attctaatacgactcactataggTCTCTTATGGAAGATACCTAgttttagagctagaaatagcaagttaaaataaggctagtccgtt atcaacttgaaaaagtggcaccgagtcggtgc (SEQ ID NO: 1727): [Target gene information]: Gene ID: 2903: Symbol: GRIN2A: Ensembl Transcript ID: EN5T00000396573.2: GRCh: 37: Chr: 16: [Target cancer mutation information]: mut start: 9858241: mut end: 9858241: mut class: Nonsense Mutation: mut type: SNP: ref seq: C: mut seq: A: mut aa: p.E1054*: mutation info source: CCLE: ref target(-10 +10):
GCCATCTCTTCTGGAAGATAC (SEQ ID NO: 1722): mut target(-10 +10):
GCCATCTCTTATGGAAGATAC (SEQ ID NO: 1723): [Model Cell line information]: cell: NCIH1573: cancer type: LUNG: PAM dist: 14: indel length: 0: CRISPR gRNA ID: GF-CCELg9-329: [crRNA sequence]: crRNA sequence: TAGGTATCTTCCATAAGAGATGG (SEQ ID NO: 1728):
SpgRNA: attctaatacgactcactataggTAGGTATCTTCCATAAGAGgttttagagctagaaatagcaagttaaaataaggctagtccgtt atcaacttgaaaaagtggcaccgagtcggtgc (SEQ ID NO: 172 9): [Target gene information]: Gene ID: 2903: Symbol: GRIN2A: Ensembl Transcript ID: EN5T00000396573.2: GRCh: 37: Chr: 16: [Target cancer mutation information]: mut start: 9858241: mut end: 9858241: mut class: Nonsense Mutation: mut type: SNP: ref seq: C: mut seq: A: mut aa: p.E1054*: mutation info source: CCLE: ref target(-10 +10):
GCCATCTCTTCTGGAAGATAC (SEQ ID NO: 1722): mut target(-10 +10):
GCCATCTCTTATGGAAGATAC (SEQ ID NO: 1723): [Model Cell line information]: cell: NCIH1573: cancer type: LUNG: PAM dist: 7: indel length: 0: CRISPR gRNA ID: GF-CCELg9-330: [crRNA sequence]: crRNA sequence: AGGATTTCAACGCTGACCTGAGG (SEQ ID NO: 1730):
SpgRNA: attctaatacgactcactataggAGGATTTCAACGCTGACCTGgttttagagctagaaatagcaagttaaaataaggctagtccgtt atcaacttgaaaaagtggcaccgagtcggtgc (SEQ ID NO: 173 1): [Target gene information]: Gene ID: 440093: Symbol: H3F3C: Ensembl Transcript ID: EN5T00000340398.3: GRCh: 37: Chr: 12: [Target cancer mutation information]: mut start: 31944863: mut end: 31944863: mut class: Missense Mutation: mut type: SNP: ref seq: T: mut seq: C: mut aa: p.T80A: mutation info source: CCLE: ref target(-10 +10):
CTCAGGTCAGTGTTGAAATCC (SEQ ID NO: 473): mut target(-10 +10):
CTCAGGTCAGCGTTGAAATCC (SEQ ID NO: 474): [Model Cell line information]: cell: NCIH1573:

TABLE 7-continued

Illustrative guide RNA sequences for polypeptides comprising Cas9 cancer type: LUNG: PAM dist: 9: indel length: 0: CRISPR gRNA ID: GF-CCELg9-331: [crRNA sequence]:
crRNA sequence: TCGGCTGGCCATCGGGATTTCGG (SEQ ID NO: 1732):
SpgRNA: attctaatacgactcactataggTCGGCTGGCCATCGGGATTTgttttagagctagaaatagcaagttaaaataaggctagtccgtt
atcaacttgaaaaagtggcaccgagtcggtgc (SEQ ID NO: 1733): [Target gene information]: Gene ID: 3082: Symbol:
HGF: Ensembl Transcript ID: EN5T00000222390.5: GRCh: 37: Chr: 7: [Target cancer mutation information]:
mut start: 81372751: mut end: 81372751: mut class: Silent: mut type: SNP: ref seq: G: mut seq: T: mut aa:
p.R261R: mutation info source: CCLE: ref target(-10 +10): CATCGGGATTGCGGCAATAAT (SEQ ID
NO: 477): mut target(-10 +10): CATCGGGATTTCGGCAATAAT (SEQ ID NO: 478): [Model Cell line
information]: cell: NCIH2126: cancer type: LUNG: PAM dist: 1: indel length: 0: CRISPR gRNA ID: GF-
CCELg9-332: [crRNA sequence]: crRNA sequence: GAAATCCCGATGGCCAGCCGAGG (SEQ ID NO:
1734):
SpgRNA: attctaatacgactcactataggGAAATCCCGATGGCCAGCCGg agagctagaaatagcaagttaaaataaggctagtccgt
tatcaacttgaaaaagtggcaccgagtcggtgc (SEQ ID NO: 173 5): [Target gene information]: Gene ID: 3082: Symbol:
HGF: Ensembl Transcript ID: EN5T00000222390.5: GRCh: 37: Chr: 7: [Target cancer mutation information]:
mut start: 81372751: mut end: 81372751: mut class: Silent: mut type: SNP: ref seq: G: mut seq: T: mut aa:
p.R261R: mutation info source: CCLE: ref target(-10 +10): CATCGGGATTGCGGCAATAAT (SEQ ID
NO: 477): mut target(-10 +10): CATCGGGATTTCGGCAATAAT (SEQ ID NO: 478): [Model Cell line
information]: cell: NCIH2126: cancer type: LUNG: PAM dist: 19: indel length: 0: CRISPR gRNA ID: GF-
CCELg9-333: [crRNA sequence]: crRNA sequence: AATTATTGCCGAAATCCCGATGG (SEQ ID NO:
1736):
SpgRNA: attctaatacgactcactataggAATTATTGCCGAAATCCCGAg agagctagaaatagcaagttaaaataaggctagtccgtt
atcaacttgaaaaagtggcaccgagtcggtgc (SEQ ID NO: 173 7): [Target gene information]: Gene ID: 3082: Symbol:
HGF: Ensembl Transcript ID: EN5T00000222390.5: GRCh: 37: Chr: 7: [Target cancer mutation information]:
mut start: 81372751: mut end: 81372751: mut class: Silent: mut type: SNP: ref seq: G: mut seq: T: mut aa:
p.R261R: mutation info source: CCLE: ref target(-10 +10): CATCGGGATTGCGGCAATAAT (SEQ ID
NO: 477): mut target(-10 +10): CATCGGGATTTCGGCAATAAT (SEQ ID NO: 478): [Model Cell line
information]: cell: NCIH2126: cancer type: LUNG: PAM dist: 9: indel length: 0: CRISPR gRNA ID: GF-
CCELg9-334: [crRNA sequence]: crRNA sequence: CCGGATCTCCCGCAGAGCCAAGG (SEQ ID NO:
1738):
SpgRNA: attctaatacgactcactataggCCGGATCTCCCGCAGAGCCAgttttagagctagaaatagcaagttaaaataaggctagtccgtt
atcaacttgaaaaagtggcaccgagtcggtgc (SEQ ID NO: 1739): [Target gene information]: Gene ID: 653604:
Symbol: HIST2H3D: Ensembl Transcript ID: EN5T00000331491.1: GRCh: 37: Chr: 1: [Target cancer
mutation information]: mut start: 149785098: mut end: 149785098: mut class: Missense Mutation: mut type:
SNP: ref seq: C: mut seq: A: mut aa: p.V47L: mutation info source: CCLE: ref target(-10 +10):
CGCAGAGCCACGGTGCCGGGC (SEQ ID NO: 1740): mut target(-10 +10):
CGCAGAGCCAAGGTGCCGGGC (SEQ ID NO: 1741): [Model Cell line information]: cell: NCIH1975:
cancer type: LUNG: PAM dist: 0: indel length: 0: CRISPR gRNA ID: GF-CCELg9-335: [crRNA sequence]:
crRNA sequence: CTCCCGCAGAGCCAAGGTGCCGG (SEQ ID NO: 1742):
SpgRNA: attctaatacgactcactataggCTCCCGCAGAGCCAAGGTGCgttttagagctagaaatagcaagttaaaataaggctagtccgtt
atcaacttgaaaaagtggcaccgagtcggtgc (SEQ ID NO: 1743): [Target gene information]: Gene ID: 653604:
Symbol: HIST2H3D: Ensembl Transcript ID: EN5T00000331491.1: GRCh: 37: Chr: 1: [Target cancer
mutation information]: mut start: 149785098: mut end: 149785098: mut class: Missense Mutation: mut type:
SNP: ref seq: C: mut seq: A: mut aa: p.V47L: mutation info source: CCLE: ref target(-10 +10):
CGCAGAGCCACGGTGCCGGGC (SEQ ID NO: 1740): mut target(-10 +10):
CGCAGAGCCAAGGTGCCGGGC (SEQ ID NO: 1741): [Model Cell line information]: cell: NCIH1975:
cancer type: LUNG: PAM dist: 6: indel length: 0: CRISPR gRNA ID: GF-CCELg9-336: [crRNA sequence]:
crRNA sequence: GCAGAGCCAAGGTGCCGGGCCGG (SEQ ID NO: 1744):
SpgRNA: attctaatacgactcactataggGCAGAGCCAAGGTGCCGGGCCGGgttttagagctagaaatagcaagttaaaataaggctagtccgt
tatcaacttgaaaaagtggcaccgagtcggtgc (SEQ ID NO: 1745): [Target gene information]: Gene ID: 653604:
Symbol: HIST2H3D: Ensembl Transcript ID: EN5T00000331491.1: GRCh: 37: Chr: 1: [Target cancer
mutation information]: mut start: 149785098: mut end: 149785098: mut class: Missense Mutation: mut type:
SNP: ref seq: C: mut seq: A: mut aa: p.V47L: mutation info source: CCLE: ref target(-10 +10):
CGCAGAGCCACGGTGCCGGGC (SEQ ID NO: 1740): mut target(-10 +10):
CGCAGAGCCAAGGTGCCGGGC (SEQ ID NO: 1741): [Model Cell line information]: cell: NCIH1975:
cancer type: LUNG: PAM dist: 11: indel length: 0: CRISPR gRNA ID: GF-CCELg9-337: [crRNA sequence]:
crRNA sequence: CCAAGGTGCCGGGCCGGTAGCGG (SEQ ID NO: 1746):
SpgRNA: attctaatacgactcactataggCCAAGGTGCCGGGCCGGTAGgttttagagctagaaatagcaagttaaaataaggctagtccgt
tatcaacttgaaaaagtggcaccgagtcggtgc (SEQ ID NO: 1747): [Target gene information]: Gene ID: 653604:
Symbol: HIST2H3D: Ensembl Transcript ID: EN5T00000331491.1: GRCh: 37: Chr: 1: [Target cancer
mutation information]: mut start: 149785098: mut end: 149785098: mut class: Missense Mutation: mut type:
SNP: ref seq: C: mut seq: A: mut aa: p.V47L: mutation info source: CCLE: ref target(-10 +10):
CGCAGAGCCACGGTGCCGGGC (SEQ ID NO: 1740): mut target(-10 +10):
CGCAGAGCCAAGGTGCCGGGC (SEQ ID NO: 1741): [Model Cell line information]: cell: NCIH1975:
cancer type: LUNG: PAM dist: 17: indel length: 0: CRISPR gRNA ID: GF-CCELg9-338: [crRNA sequence]:
crRNA sequence: TCCCGCAGAGCCAAGGTGCCGGG (SEQ ID NO: 1748):
SpgRNA: attctaatacgactcactataggTCCCGCAGAGCCAAGGTGCCgttttagagctagaaatagcaagttaaaataaggctagtccgtt
atcaacttgaaaaagtggcaccgagtcggtgc (SEQ ID NO: 1749): [Target gene information]: Gene ID: 653604:
Symbol: HIST2H3D: Ensembl Transcript ID: EN5T00000331491.1: GRCh: 37: Chr: 1: [Target cancer
mutation information]: mut start: 149785098: mut end: 149785098: mut class: Missense Mutation: mut type:
SNP: ref seq: C: mut seq: A: mut aa: p.V47L: mutation info source: CCLE: ref target(-10 +10):
CGCAGAGCCACGGTGCCGGGC (SEQ ID NO: 1740): mut target(-10 +10):
CGCAGAGCCAAGGTGCCGGGC (SEQ ID NO: 1741): [Model Cell line information]: cell: NCIH1975:
cancer type: LUNG: PAM dist: 7: indel length: 0: CRISPR gRNA ID: GF-CCELg9-339: [crRNA sequence]:
crRNA sequence: CCGCTACCGGCCCGGCACCTTGG (SEQ ID NO: 1750):
SpgRNA: attctaatacgactcactataggCCGCTACCGGCCCGGCACCT gttttagagctagaaatagcaagttaaaataaggctagtccgtt
atcaacttgaaaaagtggcaccgagtcggtgc (SEQ ID NO: 1751): [Target gene information]: Gene ID: 653604:
Symbol: HIST2H3D: Ensembl Transcript ID: EN5T00000331491.1: GRCh: 37: Chr: 1: [Target cancer
mutation information]: mut start: 149785098: mut end: 149785098: mut class: Missense Mutation: mut type:

TABLE 7-continued

Illustrative guide RNA sequences for polypeptides comprising Cas9

SNP: ref seq: C: mut seq: A: mut aa: p.V47L: mutation info source: CCLE: ref target(-10 +10):
CGCAGAGCCACGGTGCCGGGC (SEQ ID NO: 1740): mut target(-10 +10):
CGCAGAGCCAAGGTGCCGGGC (SEQ ID NO: 1741): [Model Cell line information]: cell: NCIH1975:
cancer type: LUNG: PAM dist: 1: indel length: 0: CRISPR gRNA ID: GF-CCELg9-340: [crRNA sequence]:
crRNA sequence: GGCCCGGCACCTTGGCTCTGCGG (SEQ ID NO: 1752):
SpgRNA: attctaatacgactcactataggGGCCCGGCACCTTGGCTCTGCGgttttagagctagaaatagcaagttaaaataaggctagtccgtt
atcaacttgaaaaagtggcaccgagtcggtgc (SEQ ID NO: 1753): [Target gene information]: Gene ID: 653604:
Symbol: HIST2H3D: Ensembl Transcript ID: EN5T00000331491.1: GRCh: 37: Chr: 1: [Target cancer
mutation information]: mut start: 149785098: mut end: 149785098: mut class: Missense Mutation: mut type:
SNP: ref seq: C: mut seq: A: mut aa: p.V47L: mutation info source: CCLE: ref target(-10 +10):
CGCAGAGCCACGGTGCCGGGC (SEQ ID NO: 1740): mut target(-10 +10):
CGCAGAGCCAAGGTGCCGGGC (SEQ ID NO: 1741): [Model Cell line information]: cell: NCIH1975:
cancer type: LUNG: PAM dist: 9: indel length: 0: CRISPR gRNA ID: GF-CCELg9-341: [crRNA sequence]:
crRNA sequence: CCTTGGCTCTGCGGGAGATCCGG (SEQ ID NO: 1754):
SpgRNA: attctaatacgactcactataggCCTTGGCTCTGCGGGAGATCCGGgttttagagctagaaatagcaagttaaaataaggctagtccgtt
atcaacttgaaaaagtggcaccgagtcggtgc (SEQ ID NO: 1755): [Target gene information]: Gene ID: 653604:
Symbol: HIST2H3D: Ensembl Transcript ID: EN5T00000331491.1: GRCh: 37: Chr: 1: [Target cancer
mutation information]: mut start: 149785098: mut end: 149785098: mut class: Missense Mutation: mut type:
SNP: ref seq: C: mut seq: A: mut aa: p.V47L: mutation info source: CCLE: ref target(-10 +10):
CGCAGAGCCACGGTGCCGGGC (SEQ ID NO: 1740): mut target(-10 +10):
CGCAGAGCCAAGGTGCCGGGC (SEQ ID NO: 1741): [Model Cell line information]: cell: NCIH1975:
cancer type: LUNG: PAM dist: 18: indel length: 0: CRISPR gRNA ID: GF-CCELg9-342: [crRNA sequence]:
crRNA sequence: GCCCGGCACCTTGGCTCTGCGGG (SEQ ID NO: 1756):
SpgRNA: attctaatacgactcactataggGCCCGGCACCTTGGCTCTGCGgttttagagctagaaatagcaagttaaaataaggctagtccgtt
atcaacttgaaaaagtggcaccgagtcggtgc (SEQ ID NO: 1757): [Target gene information]: Gene ID: 653604:
Symbol: HIST2H3D: Ensembl Transcript ID: EN5T00000331491.1: GRCh: 37: Chr: 1: [Target cancer
mutation information]: mut start: 149785098: mut end: 149785098: mut class: Missense Mutation: mut type:
SNP: ref seq: C: mut seq: A: mut aa: p.V47L: mutation info source: CCLE: ref target(-10 +10):
CGCAGAGCCACGGTGCCGGGC (SEQ ID NO: 1740): mut target(-10 +10):
CGCAGAGCCAAGGTGCCGGGC (SEQ ID NO: 1741): [Model Cell line information]: cell: NCIH1975:
cancer type: LUNG: PAM dist: 10: indel length: 0: CRISPR gRNA ID: GF-CCELg9-343: [crRNA sequence]:
crRNA sequence: TAATTCTGTGGTACCTCAGAAGG (SEQ ID NO: 1758):
SpgRNA: attctaatacgactcactataggTAATTCTGTGGTACCTCAGAgttttagagctagaaatagcaagttaaaataaggctagtccgtt
atcaacttgaaaaagtggcaccgagtcggtgc (SEQ ID NO: 1759): [Target gene information]: Gene ID: 6927: Symbol:
HNF1A: Ensembl Transcript ID: ENST00000402929.1: GRCh: 37: Chr: 12: [Target cancer mutation
information]: mut start: 121434774: mut end: 121434774: mut class: Missense Mutation: mut type: SNP: ref
seq: C: mut seq: T: mut aa: p.S513L: mutation info source: CCLE: ref target(-10 +10):
CATAATACATCAATTCTGTGG (SEQ ID NO: 1760): mut target(-10 +10):
CATAATACATTAATTCTGTGG (SEQ ID NO: 1761): [Model Cell line information]: cell: HCC827GR5:
cancer type: LUNG: PAM dist: 20: indel length: 0: CRISPR gRNA ID: GF-CCELg9-344: [crRNA sequence]:
crRNA sequence: AGCATAATACATTAATTCTGTGG (SEQ ID NO: 1762):
SpgRNA: attctaatacgactcactataggAGCATAATACATTAATTCTGTgttttagagctagaaatagcaagttaaaataaggctagtccgtt
atcaacttgaaaaagtggcaccgagtcggtgc (SEQ ID NO: 1763): [Target gene information]: Gene ID: 6927: Symbol:
HNF1A: Ensembl Transcript ID: ENST00000402929.1: GRCh: 37: Chr: 12: [Target cancer mutation
information]: mut start: 121434774: mut end: 121434774: mut class: Missense Mutation: mut type: SNP: ref
seq: C: mut seq: T: mut aa: p.S513L: mutation info source: CCLE: ref target(-10 +10):
CATAATACATCAATTCTGTGG (SEQ ID NO: 1760): mut target(-10 +10):
CATAATACATTAATTCTGTGG (SEQ ID NO: 1761): [Model Cell line information]: cell: HCC827GR5:
cancer type: LUNG: PAM dist: 8: indel length: 0: CRISPR gRNA ID: GF-CCELg9-345: [crRNA sequence]:
crRNA sequence: TAATTCTGTGGTACCTCAGAAGG (SEQ ID NO: 1758):
SpgRNA: attctaatacgactcactataggTAATTCTGTGGTACCTCAGAgttttagagctagaaatagcaagttaaaataaggctagtccgtt
atcaacttgaaaaagtggcaccgagtcggtgc (SEQ ID NO: 1759): [Target gene information]: Gene ID: 6927: Symbol:
HNF1A: Ensembl Transcript ID: ENST00000402929.1: GRCh: 37: Chr: 12: [Target cancer mutation
information]: mut start: 121434774: mut end: 121434774: mut class: Missense Mutation: mut type: SNP: ref
seq: C: mut seq: T: mut aa: p.S513L: mutation info source: CCLE: ref target(-10 +10):
CATAATACATCAATTCTGTGG (SEQ ID NO: 1760): mut target(-10 +10):
CATAATACATTAATTCTGTGG (SEQ ID NO: 1761): [Model Cell line information]: cell: HCC827:
cancer type: LUNG: PAM dist: 20: indel length: 0: CRISPR gRNA ID: GF-CCELg9-346: [crRNA sequence]:
crRNA sequence: AGCATAATACATTAATTCTGTGG (SEQ ID NO: 1762):
SpgRNA: attctaatacgactcactataggAGCATAATACATTAATTCTGtgttttagagctagaaatagcaagttaaaataaggctagtccgtt
atcaacttgaaaaagtggcaccgagtcggtgc (SEQ ID NO: 1763): [Target gene information]: Gene ID: 6927: Symbol:
HNF1A: Ensembl Transcript ID: ENST00000402929.1: GRCh: 37: Chr: 12: [Target cancer mutation
information]: mut start: 121434774: mut end: 121434774: mut class: Missense Mutation: mut type: SNP: ref
seq: C: mut seq: T: mut aa: p.S513L: mutation info source: CCLE: ref target(-10 +10):
CATAATACATCAATTCTGTGG (SEQ ID NO: 1760): mut target(-10 +10):
CATAATACATTAATTCTGTGG (SEQ ID NO: 1761): [Model Cell line information]: cell: HCC827:
cancer type: LUNG: PAM dist: 8: indel length: 0: CRISPR gRNA ID: GF-CCELg9-347: [crRNA sequence]:
crRNA sequence: GGCCATTAAAACAGTGAACAAGG (SEQ ID NO: 1764):
SpgRNA: attctaatacgactcactataggGGCCATTAAAACAGTGAACAgttttagagctagaaatagcaagttaaaataaggctagtccgt
tatcaacttgaaaaagtggcaccgagtcggtgc (SEQ ID NO: 1765): [Target gene information]: Gene ID: 3480: Symbol:
IGF1R: Ensembl Transcript ID: EN5T00000268035.6: GRCh: 37: Chr: 15: [Target cancer mutation
information]: mut start: 99478205: mut end: 99478205: mut class: Missense Mutation: mut type: SNP: ref
seq: G: mut seq: A: mut aa: p.E1037K: mutation info source: CCLE: ref target(-10 +10):
AACAGTGAACGAGGCCGCAAG (SEQ ID NO: 1766): mut target(-10 +10):
AACAGTGAACAAGGCCGCAAG (SEQ ID NO: 1767): [Model Cell line information]: cell: NCIH1975:
cancer type: LUNG: PAM dist: 1: indel length: 0: CRISPR gRNA ID: GF-CCELg9-348: [crRNA sequence]:
crRNA sequence: GGCCTTGTTCACTGTTTTAATGG (SEQ ID NO: 1768):

TABLE 7-continued

Illustrative guide RNA sequences for polypeptides comprising Cas9

SpgRNA: attctaatacgactcactataggGGCCTTGTTCACTGTTTTAAgttttagagctagaaatagcaagttaaaataaggctagtccgtta
tcaacttgaaaaagtggcaccgagtcggtgc (SEQ ID NO: 1769): [Target gene information]: Gene ID: 3480: Symbol:
IGF1R: Ensembl Transcript ID: EN5T00000268035.6: GRCh: 37: Chr: 15: [Target cancer mutation
information]: mut start: 99478205: mut end: 99478205: mut class: Missense Mutation: mut type: SNP: ref
seq: G: mut seq: A: mut aa: p.E1037K: mutation info source: CCLE: ref target(-10 +10):
AACAGTGAACGAGGCCGCAAG (SEQ ID NO: 1766): mut target(-10 +10):
AACAGTGAACAAGGCCGCAAG (SEQ ID NO: 1767): [Model Cell line information]: cell: NCIH1975:
cancer type: LUNG: PAM dist: 15: indel length: 0: CRISPR gRNA ID: GF-CCELg9-349: [crRNA sequence]:
crRNA sequence: CAGGACCTCCTGCGTAGCCTTGG (SEQ ID NO: 1770):
SpgRNA: attctaatacgactcactataggCAGGACCTCCTGCGTAGCCTgttttagagctagaaatagcaagttaaaataaggctagtccgtt
atcaacttgaaaaagtggcaccgagtcggtgc (SEQ ID NO: 1771): [Target gene information]: Gene ID: 3575: Symbol:
IL7R: Ensembl Transcript ID: ENST00000303115.3: GRCh: 37: Chr: 5: [Target cancer mutation
information]: mut start: 35876425: mut end: 35876425: mut class: Missense Mutation: mut type: SNP: ref
seq: T: mut seq: G: mut aa: p.L406R: mutation info source: CCLE: ref target(-10 +10):
GACCTCCTGCTTAGCCTTGGG (SEQ ID NO: 487): mut target(-10 +10):
GACCTCCTGCGTAGCCTTGGG (SEQ ID NO: 488): [Model Cell line information]: cell: NCIH2126:
cancer type: LUNG: PAM dist: 7: indel length: 0: CRISPR gRNA ID: GF-CCELg9-350: [crRNA sequence]:
crRNA sequence: AGGACCTCCTGCGTAGCCTTGGG (SEQ ID NO: 1772):
SpgRNA: attctaatacgactcactataggAGGACCTCCTGCGTAGCCTTgttttagagctagaaatagcaagttaaaataaggctagtccgtt
atcaacttgaaaaagtggcaccgagtcggtgc (SEQ ID NO: 1773): [Target gene information]: Gene ID: 3575: Symbol:
IL7R: Ensembl Transcript ID: ENST00000303115.3: GRCh: 37: Chr: 5: [Target cancer mutation
information]: mut start: 35876425: mut end: 35876425: mut class: Missense Mutation: mut type: SNP: ref
seq: T: mut seq: G: mut aa: p.L406R: mutation info source: CCLE: ref target(-10 +10):
GACCTCCTGCTTAGCCTTGGG (SEQ ID NO: 487): mut target(-10 +10):
GACCTCCTGCGTAGCCTTGGG (SEQ ID NO: 488): [Model Cell line information]: cell: NCIH2126:
cancer type: LUNG: PAM dist: 8: indel length: 0: CRISPR gRNA ID: GF-CCELg9-351: [crRNA sequence]:
crRNA sequence: TTGTAGTCCCAAGGCTACGCAGG (SEQ ID NO: 1774):
SpgRNA: attctaatacgactcactataggTTGTAGTCCCAAGGCTACGCgttttagagctagaaatagcaagttaaaataaggctagtccgtt
atcaacttgaaaaagtggcaccgagtcggtgc (SEQ ID NO: 1775): [Target gene information]: Gene ID: 3575: Symbol:
IL7R: Ensembl Transcript ID: ENST00000303115.3: GRCh: 37: Chr: 5: [Target cancer mutation
information]: mut start: 35876425: mut end: 35876425: mut class: Missense Mutation: mut type: SNP: ref
seq: T: mut seq: G: mut aa: p.L406R: mutation info source: CCLE: ref target(-10 +10):
GACCTCCTGCTTAGCCTTGGG (SEQ ID NO: 487): mut target(-10 +10):
GACCTCCTGCGTAGCCTTGGG (SEQ ID NO: 488): [Model Cell line information]: cell: NCIH2126:
cancer type: LUNG: PAM dist: 3: indel length: 0: CRISPR gRNA ID: GF-CCELg9-352: [crRNA sequence]:
crRNA sequence: TAGTCCCAAGGCTACGCAGGAGG (SEQ ID NO: 1776):
SpgRNA: attctaatacgactcactataggTAGTCCCAAGGCTACGCAGGgttttagagctagaaatagcaagttaaaataaggctagtccgtt
atcaacttgaaaaagtggcaccgagtcggtgc (SEQ ID NO: 1777): [Target gene information]: Gene ID: 3575: Symbol:
IL7R: Ensembl Transcript ID: ENST00000303115.3: GRCh: 37: Chr: 5: [Target cancer mutation
information]: mut start: 35876425: mut end: 35876425: mut class: Missense Mutation: mut type: SNP: ref
seq: T: mut seq: G: mut aa: p.L406R: mutation info source: CCLE: ref target(-10 +10):
GACCTCCTGCTTAGCCTTGGG (SEQ ID NO: 487): mut target(-10 +10):
GACCTCCTGCGTAGCCTTGGG (SEQ ID NO: 488): [Model Cell line information]: cell: NCIH2126:
cancer type: LUNG: PAM dist: 6: indel length: 0: CRISPR gRNA ID: GF-CCELg9-353: [crRNA sequence]:
crRNA sequence: CAAGGCTACGCAGGAGGTCCTGG (SEQ ID NO: 1778):
SpgRNA: attctaatacgactcactataggCAAGGCTACGCAGGAGGTCCgttttagagctagaaatagcaagttaaaataaggctagtccgt
tatcaacttgaaaaagtggcaccgagtcggtgc (SEQ ID NO: 1779): [Target gene information]: Gene ID: 3575: Symbol:
IL7R: Ensembl Transcript ID: ENST00000303115.3: GRCh: 37: Chr: 5: [Target cancer mutation
information]: mut start: 35876425: mut end: 35876425: mut class: Missense Mutation: mut type: SNP: ref
seq: T: mut seq: G: mut aa: p.L406R: mutation info source: CCLE: ref target(-10 +10):
GACCTCCTGCTTAGCCTTGGG (SEQ ID NO: 487): mut target(-10 +10):
GACCTCCTGCGTAGCCTTGGG (SEQ ID NO: 488): [Model Cell line information]: cell: NCIH2126:
cancer type: LUNG: PAM dist: 12: indel length: 0: CRISPR gRNA ID: GF-CCELg9-354: [crRNA sequence]:
crRNA sequence: TCTCAACTCCCCTGATGTCCTGG (SEQ ID NO: 1780):
SpgRNA: attctaatacgactcactataggTCTCAACTCCCCTGATGTCCgttttagagctagaaatagcaagttaaaataaggctagtccgtta
tcaacttgaaaaagtggcaccgagtcggtgc (SEQ ID NO: 1781): [Target gene information]: Gene ID: 3623: Symbol:
INHA: Ensembl Transcript ID: EN5T00000243786.2: GRCh: 37: Chr: 2: [Target cancer mutation
information]: mut start: 220439842: mut end: 220439842: mut class: Missense Mutation: mut type: SNP: ref
seq: G: mut seq: T: mut aa: p.R232L: mutation info source: CCLE: ref target(-10 +10):
AGAGCCCGACGCTCAACTCCC (SEQ ID NO: 1782): mut target(-10 +10):
AGAGCCCGACTCTCAACTCCC (SEQ ID NO: 1783): [Model Cell line information]: cell: NCIH1573:
cancer type: LUNG: PAM dist: 20: indel length: 0: CRISPR gRNA ID: GF-CCELg9-355: [crRNA sequence]:
crRNA sequence: ACATCAGGGGAGTTGAGAGTCGG (SEQ ID NO: 1784):
SpgRNA: attctaatacgactcactataggACATCAGGGGAGTTGAGAGTgttttagagctagaaatagcaagttaaaataaggctagtccgt
tatcaacttgaaaaagtggcaccgagtcggtgc (SEQ ID NO: 1785): [Target gene information]: Gene ID: 3623: Symbol:
INHA: Ensembl Transcript ID: ENST00000243786.2: GRCh: 37: Chr: 2: [Target cancer mutation
information]: mut start: 220439842: mut end: 220439842: mut class: Missense Mutation: mut type: SNP: ref
seq: G: mut seq: T: mut aa: p.R232L: mutation info source: CCLE: ref target(-10 +10):
AGAGCCCGACGCTCAACTCCC (SEQ ID NO: 1782): mut target(-10 +10):
AGAGCCCGACTCTCAACTCCC (SEQ ID NO: 1783): [Model Cell line information]: cell: NCIH1573:
cancer type: LUNG: PAM dist: 3: indel length: 0: CRISPR gRNA ID: GF-CCELg9-356: [crRNA sequence]:
crRNA sequence: CATCAGGGGAGTTGAGAGTCGGG (SEQ ID NO: 1786):
SpgRNA: attctaatacgactcactataggCATCAGGGGAGTTGAGAGTgttttagagctagaaatagcaagttaaaataaggctagtccgt
tatcaacttgaaaaagtggcaccgagtcggtgc (SEQ ID NO: 1787): [Target gene information]: Gene ID: 3623: Symbol:
INHA: Ensembl Transcript ID: EN5T00000243786.2: GRCh: 37: Chr: 2: [Target cancer mutation
information]: mut start: 220439842: mut end: 220439842: mut class: Missense Mutation: mut type: SNP: ref
seq: G: mut seq: T: mut aa: p.R232L: mutation info source: CCLE: ref target(-10 +10):
AGAGCCCGACGCTCAACTCCC (SEQ ID NO: 1782): mut target(-10 +10):

TABLE 7-continued

Illustrative guide RNA sequences for polypeptides comprising Cas9

AGAGCCCGACTCTCAACTCCC (SEQ ID NO: 1783): [Model Cell line information]: cell: NCIH1573:
cancer type: LUNG: PAM dist: 4: indel length: 0: CRISPR gRNA ID: GF-CCELg9-357: [crRNA sequence]:
crRNA sequence: TGAAAATGCGAAATATCTGAAGG (SEQ ID NO: 1788):
SpgRNA: attctaatacgactcactataggTGAAAATGCGAAATATCTGAgttttagagctagaaatagcaagttaaaataaggctagtccgtt
atcaacttgaaaaagtggcaccgagtcggtgc (SEQ ID NO: 1789): [Target gene information]: Gene ID: 8821: Symbol:
INPP4B: Ensembl Transcript ID: ENST00000513000.1: GRCh: 37: Chr: 4: [Target cancer mutation
information]: mut start: 143007402: mut end: 143007402: mut class: Silent: mut type: SNP: ref seq: T: mut
seq: C: mut aa: p.S794S: mutation info source: CCLE: ref target(-10 +10):
CCTGAAAATGTGAAATATCTG (SEQ ID NO: 491): mut target(-10 +10):
CCTGAAAATGCGAAATATCTG (SEQ ID NO: 492): [Model Cell line information]: cell: NCIH2126:
cancer type: LUNG: PAM dist: 12: indel length: 0: CRISPR gRNA ID: GF-CCELg9-358: [crRNA sequence]:
crRNA sequence: GAAAATGCGAAATATCTGAAGGG (SEQ ID NO: 1790):
SpgRNA: attctaatacgactcactataggGAAAATGCGAAATATCTGAAgttttagagctagaaatagcaagttaaaataaggctagtccgt
tatcaacttgaaaaagtggcaccgagtcggtgc (SEQ ID NO: 1791): [Target gene information]: Gene ID: 8821: Symbol:
INPP4B: Ensembl Transcript ID: ENST00000513000.1: GRCh: 37: Chr: 4: [Target cancer mutation
information]: mut start: 143007402: mut end: 143007402: mut class: Silent: mut type: SNP: ref seq: T: mut
seq: C: mut aa: p.S794S: mutation info source: CCLE: ref target(-10 +10):
CCTGAAAATGTGAAATATCTG (SEQ ID NO: 491): mut target(-10 +10):
CCTGAAAATGCGAAATATCTG (SEQ ID NO: 492): [Model Cell line information]: cell: NCIH2126:
cancer type: LUNG: PAM dist: 13: indel length: 0: CRISPR gRNA ID: GF-CCELg9-359: [crRNA sequence]:
crRNA sequence: AAAATGCGAAATATCTGAAGGGG (SEQ ID NO: 1792):
SpgRNA: attctaatacgactcactataggAAAATGCGAAATATCTGAAGgttttagagctagaaatagcaagttaaaataaggctagtccgt
tatcaacttgaaaaagtggcaccgagtcggtgc (SEQ ID NO: 1793): [Target gene information]: Gene ID: 8821: Symbol:
INPP4B: Ensembl Transcript ID: ENST00000513000.1: GRCh: 37: Chr: 4: [Target cancer mutation
information]: mut start: 143007402: mut end: 143007402: mut class: Silent: mut type: SNP: ref seq: T: mut
seq: C: mut aa: p.S794S: mutation info source: CCLE: ref target(-10 +10):
CCTGAAAATGTGAAATATCTG (SEQ ID NO: 491): mut target(-10 +10):
CCTGAAAATGCGAAATATCTG (SEQ ID NO: 492): [Model Cell line information]: cell: NCIH2126:
cancer type: LUNG: PAM dist: 14: indel length: 0: CRISPR gRNA ID: GF-CCELg9-360: [crRNA sequence]:
crRNA sequence: TTCAGATATTTCGCATTTTCAGG (SEQ ID NO: 1794):
SpgRNA: attctaatacgactcactataggTTCAGATATTTCGCATTTTCGttttagagctagaaatagcaagttaaaataaggctagtccgtta
tcaacttgaaaaagtggcaccgagtcggtgc (SEQ ID NO: 1795): [Target gene information]: Gene ID: 8821: Symbol:
INPP4B: Ensembl Transcript ID: ENST00000513000.1: GRCh: 37: Chr: 4: [Target cancer mutation
information]: mut start: 143007402: mut end: 143007402: mut class: Silent: mut type: SNP: ref seq: T: mut
seq: C: mut aa: p.S794S: mutation info source: CCLE: ref target(-10 +10):
CCTGAAAATGTGAAATATCTG (SEQ ID NO: 491): mut target(-10 +10):
CCTGAAAATGCGAAATATCTG (SEQ ID NO: 492): [Model Cell line information]: cell: NCIH2126:
cancer type: LUNG: PAM dist: 8: indel length: 0: CRISPR gRNA ID: GF-CCELg9-361: [crRNA sequence]:
crRNA sequence: TTGCTCCTCTTCCGGGTCTATGG (SEQ ID NO: 1796):
SpgRNA: attctaatacgactcactataggTTGCTCCTCTTCCGGGTCTAgttttagagctagaaatagcaagttaaaataaggctagtccgtta
tcaacttgaaaaagtggcaccgagtcggtgc (SEQ ID NO: 1797): [Target gene information]: Gene ID: 3643: Symbol:
NSR: Ensembl Transcript ID: EN5T00000302850.5: GRCh: 37: Chr: 19: [Target cancer mutation
informa-
tion]: mut start: 7267741: mut end: 7267741: mut class: Silent: mut type: SNP: ref seq: C: mut seq:
G: mut aa: p.L89L: mutation info source: CCLE: ref target(-10 +10): CCCGGAAGAGCAGCAAGTAAT
(SEQ ID NO: 1798): mut target(-10 +10): CCCGGAAGAGGAGCAAGTAAT (SEQ ID NO: 1799):
[Model Cell line information]: cell: NCIH661: cancer type: LUNG: PAM dist: 15: indel length: 0: CRISPR
gRNA ID: GF-CCELg9-362: [crRNA sequence]: crRNA sequence: CTGATTACTTGCTCCTCTTCCGG
(SEQ ID NO: 1800):
SpgRNA: attctaatacgactcactataggCTGATTACTTGCTCCTCTTCgttttagagctagaaatagcaagttaaaataaggctagtccgttat
caacttgaaaaagtggcaccgagtcggtgc (SEQ ID NO: 1801): [Target gene information]: Gene ID: 3643: Symbol:
NSR: Ensembl Transcript ID: ENST00000302850.5: GRCh: 37: Chr: 19: [Target cancer mutation
informa-
tion]: mut start: 7267741: mut end: 7267741: mut class: Silent: mut type: SNP: ref seq: C: mut seq:
G: mut aa: p.L89L: mutation info source: CCLE: ref target(-10 +10): CCCGGAAGAGCAGCAAGTAAT
(SEQ ID NO: 1798): mut target(-10 +10): CCCGGAAGAGGAGCAAGTAAT (SEQ ID NO: 1799):
[Model Cell line information]: cell: NCIH661: cancer type: LUNG: PAM dist: 7: indel length: 0: CRISPR
gRNA ID: GF-CCELg9-363: [crRNA sequence]: crRNA sequence: TGATTACTTGCTCCTCTTCCGGG
(SEQ ID NO: 1802):
SpgRNA: attctaatacgactcactataggTGATTACTTGCTCCTCTTCCgttttagagctagaaatagcaagttaaaataaggctagtccgttat
caacttgaaaaagtggcaccgagtcggtgc (SEQ ID NO: 1803): [Target gene information]: Gene ID: 3643: Symbol:
NSR: Ensembl Transcript ID: EN5T00000302850.5: GRCh: 37: Chr: 19: [Target cancer mutation
informa-
tion]: mut start: 7267741: mut end: 7267741: mut class: Silent: mut type: SNP: ref seq: C: mut seq:
G: mut aa: p.L89L: mutation info source: CCLE: ref target(-10 +10): CCCGGAAGAGCAGCAAGTAAT
(SEQ ID NO: 1798): mut target(-10 +10): CCCGGAAGAGGAGCAAGTAAT (SEQ ID NO: 1799):
[Model Cell line information]: cell: NCIH661: cancer type: LUNG: PAM dist: 8: indel length: 0: CRISPR
gRNA ID: GF-CCELg9-364: [crRNA sequence]: crRNA sequence: TGCTCCTCTTCCGGGTCTATGGG
(SEQ ID NO: 1804):
SpgRNA: attctaatacgactcactataggTGCTCCTCTTCCGGGTCTATgttttagagctagaaatagcaagttaaaataaggctagtccgtta
tcaacttgaaaaagtggcaccgagtcggtgc (SEQ ID NO: 1805): [Target gene information]: Gene ID: 3643: Symbol:
NSR: Ensembl Transcript ID: EN5T00000302850.5: GRCh: 37: Chr: 19: [Target cancer mutation
informa-
tion]: mut start: 7267741: mut end: 7267741: mut class: Silent: mut type: SNP: ref seq: C: mut seq:
G: mut aa: p.L89L: mutation info source: CCLE: ref target(-10 +10): CCCGGAAGAGCAGCAAGTAAT
(SEQ ID NO: 1798): mut target(-10 +10): CCCGGAAGAGGAGCAAGTAAT (SEQ ID NO: 1799):

TABLE 7-continued

Illustrative guide RNA sequences for polypeptides comprising Cas9

[Model Cell line information]: cell: NCIH661: cancer type: LUNG: PAM dist: 16: indel length: 0: CRISPR gRNA ID: GF-CCELg9-365: [crRNA sequence]: crRNA sequence: GGACACGCTGGCGGGACTCATGG (SEQ ID NO: 1806):
SpgRNA: attctaatacgactcactataggGGACACGCTGGCGGGACTCAgttttagagctagaaatagcaagttaaaataaggctagtccgt tatcaacttgaaaaagtggcaccgagtcggtgc (SEQ ID NO: 1807): [Target gene information]: Gene ID: 8660: Symbol: IRS2: Ensembl Transcript ID: EN5T00000375856.3: GRCh: 37: Chr: 13: [Target cancer mutation information]: mut start: 110436364: mut end: 110436364: mut class: Silent: mut type: SNP: ref seq: G: mut seq: A: mut aa: p.S679S: mutation info source: CCLE: ref target(-10 +10):
CGCTGGCGGGGCTCATGGGCA (SEQ ID NO: 1808): mut target(-10 +10):
CGCTGGCGGGACTCATGGGCA (SEQ ID NO: 1809): [Model Cell line information]: cell: NCIH1563: cancer type: LUNG: PAM dist: 5: indel length: 0: CRISPR gRNA ID: GF-CCELg9-366: [crRNA sequence]: crRNA sequence: GACACGCTGGCGGGACTCATGG (SEQ ID NO: 1810):
SpgRNA: attctaatacgactcactataggGACACGCTGGCGGGACTCAT gttttagagctagaaatagcaagttaaaataaggctagtccgtt atcaacttgaaaaagtggcaccgagtcggtgc (SEQ ID NO: 1811): [Target gene information]: Gene ID: 8660: Symbol: IRS2: Ensembl Transcript ID: EN5T00000375856.3: GRCh: 37: Chr: 13: [Target cancer mutation information]: mut start: 110436364: mut end: 110436364: mut class: Silent: mut type: SNP: ref seq: G: mut seq: A: mut aa: p.S679S: mutation info source: CCLE: ref target(-10 +10):
CGCTGGCGGGGCTCATGGGCA (SEQ ID NO: 1808): mut target(-10 +10):
CGCTGGCGGGACTCATGGGCA (SEQ ID NO: 1809): [Model Cell line information]: cell: NCIH1563: cancer type: LUNG: PAM dist: 6: indel length: 0: CRISPR gRNA ID: GF-CCELg9-367: [crRNA sequence]: crRNA sequence: ACTGGAGTATCTGTTTGCTTAGG (SEQ ID NO: 1812):
SpgRNA: attctaatacgactcactataggACTGGAGTATCTGTTTGCTT gttttagagctagaaatagcaagttaaaataaggctagtccgtta tcaacttgaaaaagtggcaccgagtcggtgc (SEQ ID NO: 1813): [Target gene information]: Gene ID: 3716: Symbol: JAK1: Ensembl Transcript ID: EN5T00000342505.4: GRCh: 37: Chr: 1: [Target cancer mutation information]: mut start: 65339055: mut end: 65339055: mut class: Nonsense Mutation: mut type: SNP: ref seq: G: mut seq: A: mut aa: p.Q161*: mutation info source: CCLE: ref target(-10 +10):
CTTCCTACCTGAGCAAACAGA (SEQ ID NO: 513): mut target(-10 +10):
CTTCCTACCTAAGCAAACAGA (SEQ ID NO: 514): [Model Cell line information]: cell: NCIH1563: cancer type: LUNG: PAM dist: 1: indel length: 0: CRISPR gRNA ID: GF-CCELg9-368: [crRNA sequence]: crRNA sequence: GAGTATCTGTTTGCTTAGGTAGG (SEQ ID NO: 1814):
SpgRNA: attctaatacgactcactataggGAGTATCTGTTTGCTTAGGT gttttagagctagaaatagcaagttaaaataaggctagtccgtta tcaacttgaaaaagtggcaccgagtcggtgc (SEQ ID NO: 1815): [Target gene information]: Gene ID: 3716: Symbol: JAK1: Ensembl Transcript ID: EN5T00000342505.4: GRCh: 37: Chr: 1: [Target cancer mutation information]: mut start: 65339055: mut end: 65339055: mut class: Nonsense Mutation: mut type: SNP: ref seq: G: mut seq: A: mut aa: p.Q161*: mutation info source: CCLE: ref target(-10 +10):
CTTCCTACCTGAGCAAACAGA (SEQ ID NO: 513): mut target(-10 +10):
CTTCCTACCTAAGCAAACAGA (SEQ ID NO: 514): [Model Cell line information]: cell: NCIH1563: cancer type: LUNG: PAM dist: 5: indel length: 0: CRISPR gRNA ID: GF-CCELg9-369: [crRNA sequence]: crRNA sequence: TAGGTAGGAAGTTTGGGCCCAGG (SEQ ID NO: 1816):
SpgRNA: attctaatacgactcactataggTAGGTAGGAAGTTTGGGCCCgttttagagctagaaatagcaagttaaaataaggctagtccgtt atcaacttgaaaaagtggcaccgagtcggtgc (SEQ ID NO: 1817): [Target gene information]: Gene ID: 3716: Symbol: JAK1: Ensembl Transcript ID: EN5T00000342505.4: GRCh: 37: Chr: 1: [Target cancer mutation information]: mut start: 65339055: mut end: 65339055: mut class: Nonsense Mutation: mut type: SNP: ref seq: G: mut seq: A: mut aa: p.Q161*: mutation info source: CCLE: ref target(-10 +10):
CTTCCTACCTGAGCAAACAGA (SEQ ID NO: 513): mut target(-10 +10):
CTTCCTACCTAAGCAAACAGA (SEQ ID NO: 514): [Model Cell line information]: cell: NCIH1563: cancer type: LUNG: PAM dist: 20: indel length: 0: CRISPR gRNA ID: GF-CCELg9-370: [crRNA sequence]: crRNA sequence: GTTTGCTTAGGTAGGAAGTTTGG (SEQ ID NO: 1818):
SpgRNA: attctaatacgactcactataggGTTTGCTTAGGTAGGAAGTTgttttagagctagaaatagcaagttaaaataaggctagtccgtt atcaacttgaaaaagtggcaccgagtcggtgc (SEQ ID NO: 1819): [Target gene information]: Gene ID: 3716: Symbol: JAK1: Ensembl Transcript ID: EN5T00000342505.4: GRCh: 37: Chr: 1: [Target cancer mutation information]: mut start: 65339055: mut end: 65339055: mut class: Nonsense Mutation: mut type: SNP: ref seq: G: mut seq: A: mut aa: p.Q161*: mutation info source: CCLE: ref target(-10 +10):
CTTCCTACCTGAGCAAACAGA (SEQ ID NO: 513): mut target(-10 +10):
CTTCCTACCTAAGCAAACAGA (SEQ ID NO: 514): [Model Cell line information]: cell: NCIH1563: cancer type: LUNG: PAM dist: 13: indel length: 0: CRISPR gRNA ID: GF-CCELg9-371: [crRNA sequence]: crRNA sequence: TTTGCTTAGGTAGGAAGTTTGGG (SEQ ID NO: 1820):
SpgRNA: attctaatacgactcactataggTTTGCTTAGGTAGGAAGTTTgttttagagctagaaatagcaagttaaaataaggctagtccgtt atcaacttgaaaaagtggcaccgagtcggtgc (SEQ ID NO: 1821): [Target gene information]: Gene ID: 3716: Symbol: JAK1: Ensembl Transcript ID: EN5T00000342505.4: GRCh: 37: Chr: 1: [Target cancer mutation information]: mut start: 65339055: mut end: 65339055: mut class: Nonsense Mutation: mut type: SNP: ref seq: G: mut seq: A: mut aa: p.Q161*: mutation info source: CCLE: ref target(-10 +10):
CTTCCTACCTGAGCAAACAGA (SEQ ID NO: 513): mut target(-10 +10):
CTTCCTACCTAAGCAAACAGA (SEQ ID NO: 514): [Model Cell line information]: cell: NCIH1563: cancer type: LUNG: PAM dist: 14: indel length: 0: CRISPR gRNA ID: GF-CCELg9-372: [crRNA sequence]: crRNA sequence: TCCATATAGATGAGTCAGCCAGG (SEQ ID NO: 1822):
SpgRNA: attctaatacgactcactataggTCCATATAGATGAGTCAGCCgttttagagctagaaatagcaagttaaaataaggctagtccgtt atcaacttgaaaaagtggcaccgagtcggtgc (SEQ ID NO: 1823): [Target gene information]: Gene ID: 3717: Symbol: JAK2: Ensembl Transcript ID: ENST00000381652.3: GRCh: 37: Chr: 9: [Target cancer mutation information]: mut start: 5029878: mut end: 5029878: mut class: Missense Mutation: mut type: SNP: ref seq: A: mut seq: G: mut aa: p.T108A: mutation info source: CCLE: ref target(-10 +10):
AGATGAGTCAACCAGGCATAA (SEQ ID NO: 1824): mut target(-10 +10):
AGATGAGTCAGCCAGGCATAA (SEQ ID NO: 1825): [Model Cell line information]: cell: 5W1990: cancer type: PANCREAS: PAM dist: 3: indel length: 0: CRISPR gRNA ID: GF-CCELg9-373: [crRNA sequence]: crRNA sequence: GCCTGGCTGACTCATCTATATGG (SEQ ID NO: 1826):
SpgRNA: attctaatacgactcactataggGCCTGGCTGACTCATCTATAgttttagagctagaaatagcaagttaaaataaggctagtccgtt atcaacttgaaaaagtggcaccgagtcggtgc (SEQ ID NO: 182 7): [Target gene information]: Gene ID: 3717: Symbol: JAK2: Ensembl Transcript ID: ENST00000381652.3: GRCh: 37: Chr: 9: [Target cancer mutation TABLE 7-continued Illustrative guide RNA sequences for polypeptides comprising Cas9 information]: mut start: 5029878: mut end: 5029878: mut class: Missense Mutation: mut type: SNP: ref seq:
A: mut seq: G: mut aa: p.T108A: mutation info source: CCLE: ref target(-10 +10):
AGATGAGTCAACCAGGCATAA (SEQ ID NO: 1824):
AGATGAGTCAGCCAGGCATAA (SEQ ID NO: 1825): [Model Cell line information]: cell: 5W1990:
cancer type: PANCREAS: PAM dist: 14: indel length: 0: CRISPR gRNA ID: GF-CCELg9-374: [crRNA
sequence]: crRNA sequence: AGCTAAGTGTCTGCGCCTTCCGG (SEQ ID NO: 1828):
SpgRNA: attctaatacgactcactataggAGCTAAGTGTCTGCGCCTTCCGGgttttagagctagaaatagcaagttaaaataaggctagtccgtt
atcaacttgaaaaagtggcaccgagtcggtgc (SEQ ID NO: 182 9): [Target gene information]: Gene ID: 3718: Symbol:
JAK3: Ensembl Transcript ID: ENST00000527670.1: GRCh: 37: Chr: 19: [Target cancer mutation
information]: mut start: 17945768: mut end: 17945768: mut class: Missense Mutation: mut type: SNP: ref
seq: C: mut seq: T: mut aa: p.E698K: mutation info source: CCLE: ref target(-10 +10):
GTCTGCGCCTCCCGGAGACAC (SEQ ID NO: 1830): mut target(-10 +10):
GTCTGCGCCTTCCGGAGACAC (SEQ ID NO: 183 1): [Model Cell line information]: cell: NCIH661:
cancer type: LUNG: PAM dist: 2: indel length: 0: CRISPR gRNA ID: GF-CCELg9-375: [crRNA sequence]:
crRNA sequence: CTGCGCCTTCCGGAGACACTCGG (SEQ ID NO: 1832):
SpgRNA: attctaatacgactcactataggCTGCGCCTTCCGGAGACACTgttttagagctagaaatagcaagttaaaataaggctagtccgtt
atcaacttgaaaaagtggcaccgagtcggtgc (SEQ ID NO: 1833): [Target gene information]: Gene ID: 3718: Symbol:
JAK3: Ensembl Transcript ID: ENST00000527670.1: GRCh: 37: Chr: 19: [Target cancer mutation
information]: mut start: 17945768: mut end: 17945768: mut class: Missense Mutation: mut type: SNP: ref
seq: C: mut seq: T: mut aa: p.E698K: mutation info source: CCLE: ref target(-10 +10):
GTCTGCGCCTCCCGGAGACAC (SEQ ID NO: 1830):
GTCTGCGCCTTCCGGAGACAC (SEQ ID NO: 183 1): [Model Cell line information]: cell: NCIH661:
cancer type: LUNG: PAM dist: 12: indel length: 0: CRISPR gRNA ID: GF-CCELg9-376: [crRNA sequence]:
crRNA sequence: TGCGCCTTCCGGAGACACTCGGG (SEQ ID NO: 1834):
SpgRNA: attctaatacgactcactataggTGCGCCTTCCGGAGACACTCGgttttagagctagaaatagcaagttaaaataaggctagtccgtt
atcaacttgaaaaagtggcaccgagtcggtgc (SEQ ID NO: 183 5): [Target gene information]: Gene ID: 3718: Symbol:
JAK3: Ensembl Transcript ID: ENST00000527670.1: GRCh: 37: Chr: 19: [Target cancer mutation
information]: mut start: 17945768: mut end: 17945768: mut class: Missense Mutation: mut type: SNP: ref
seq: C: mut seq: T: mut aa: p.E698K: mutation info source: CCLE: ref target(-10 +10):
GTCTGCGCCTCCCGGAGACAC (SEQ ID NO: 1830):
GTCTGCGCCTTCCGGAGACAC (SEQ ID NO: 183 1): [Model Cell line information]: cell: NCIH661:
cancer type: LUNG: PAM dist: 13: indel length: 0: CRISPR gRNA ID: GF-CCELg9-377: [crRNA sequence]:
crRNA sequence: GCGCCTTCCGGAGACACTCGGGG (SEQ ID NO: 1836):
SpgRNA: attctaatacgactcactataggGCGCCTTCCGGAGACACTCGgttttagagctagaaatagcaagttaaaataaggctagtccgtt
atcaacttgaaaaagtggcaccgagtcggtgc (SEQ ID NO: 183 7): [Target gene information]: Gene ID: 3718: Symbol:
JAK3: Ensembl Transcript ID: ENST00000527670.1: GRCh: 37: Chr: 19: [Target cancer mutation
information]: mut start: 17945768: mut end: 17945768: mut class: Missense Mutation: mut type: SNP: ref
seq: C: mut seq: T: mut aa: p.E698K: mutation info source: CCLE: ref target(-10 +10):
GTCTGCGCCTCCCGGAGACAC (SEQ ID NO: 1830):
GTCTGCGCCTTCCGGAGACAC (SEQ ID NO: 183 1): [Model Cell line information]: cell: NCIH661:
cancer type: LUNG: PAM dist: 14: indel length: 0: CRISPR gRNA ID: GF-CCELg9-378: [crRNA sequence]:
crRNA sequence: CGCCTTCCGGAGACACTCGGGGG (SEQ ID NO: 1838):
SpgRNA: attctaatacgactcactataggCGCCTTCCGGAGACACTCGGgttttagagctagaaatagcaagttaaaataaggctagtccgtt
atcaacttgaaaaagtggcaccgagtcggtgc (SEQ ID NO: 183 9): [Target gene information]: Gene ID: 3718: Symbol:
JAK3: Ensembl Transcript ID: ENST00000527670.1: GRCh: 37: Chr: 19: [Target cancer mutation
information]: mut start: 17945768: mut end: 17945768: mut class: Missense Mutation: mut type: SNP: ref
seq: C: mut seq: T: mut aa: p.E698K: mutation info source: CCLE: ref target(-10 +10):
GTCTGCGCCTCCCGGAGACAC (SEQ ID NO: 1830): mut target(-10 +10):
GTCTGCGCCTTCCGGAGACAC (SEQ ID NO: 183 1): [Model Cell line information]: cell: NCIH661:
cancer type: LUNG: PAM dist: 15: indel length: 0: CRISPR gRNA ID: GF-CCELg9-379: [crRNA sequence]:
crRNA sequence: GGCCCCCGAGTGTCTCCGGAAGG (SEQ ID NO: 1840):
SpgRNA: attctaatacgactcactataggGGCCCCCGAGTGTCTCCGGAgttttagagctagaaatagcaagttaaaataaggctagtccgtt
atcaacttgaaaaagtggcaccgagtcggtgc (SEQ ID NO: 184 1): [Target gene information]: Gene ID: 3718: Symbol:
JAK3: Ensembl Transcript ID: ENST00000527670.1: GRCh: 37: Chr: 19: [Target cancer mutation
information]: mut start: 17945768: mut end: 17945768: mut class: Missense Mutation: mut type: SNP: ref
seq: C: mut seq: T: mut aa: p.E698K: mutation info source: CCLE: ref target(-10 +10):
GTCTGCGCCTCCCGGAGACAC (SEQ ID NO: 1830):
GTCTGCGCCTTCCGGAGACAC (SEQ ID NO: 183 1): [Model Cell line information]: cell: NCIH661:
cancer type: LUNG: PAM dist: 1: indel length: 0: CRISPR gRNA ID: GF-CCELg9-380: [crRNA sequence]:
crRNA sequence: GAAGGCGCAGACACTTAGCTTGG (SEQ ID NO: 1842):
SpgRNA: attctaatacgactcactataggGAAGGCGCAGACACTTAGCTgttttagagctagaaatagcaagttaaaataaggctagtccgt
tatcaacttgaaaaagtggcaccgagtcggtgc (SEQ ID NO: 1843): [Target gene information]: Gene ID: 3718: Symbol:
JAK3: Ensembl Transcript ID: ENST00000527670.1: GRCh: 37: Chr: 19: [Target cancer mutation
information]: mut start: 17945768: mut end: 17945768: mut class: Missense Mutation: mut type: SNP: ref
seq: C: mut seq: T: mut aa: p.E698K: mutation info source: CCLE: ref target(-10 +10):
GTCTGCGCCTCCCGGAGACAC (SEQ ID NO: 1830):
GTCTGCGCCTTCCGGAGACAC (SEQ ID NO: 1831): [Model Cell line information]: cell: NCIH661:
cancer type: LUNG: PAM dist: 19: indel length: 0: CRISPR gRNA ID: GF-CCELg9-381: [crRNA sequence]:
crRNA sequence: CGACCTGGACACATACAGTGAGG (SEQ ID NO: 1844):
SpgRNA: attctaatacgactcactataggCGACCTGGACACATACAGTGgttttagagctagaaatagcaagttaaaataaggctagtccgtt
atcaacttgaaaaagtggcaccgagtcggtgc (SEQ ID NO: 1845): [Target gene information]: Gene ID: 3718: Symbol:
JAK3: Ensembl Transcript ID: ENST00000527670.1: GRCh: 37: Chr: 19: [Target cancer mutation
information]: mut start: 17951048: mut end: 17951048: mut class: Silent: mut type: SNP: ref seq: G: mut
seq: T: mut aa: p.V415V: mutation info source: CCLE: ref target(-10 +10):
CCTGGACACAGACAGTGAGGA (SEQ ID NO: 533): mut target(-10 +10):
CCTGGACACATACAGTGAGGA (SEQ ID NO: 534): [Model Cell line information]: cell: NCIH1975:
cancer type: LUNG: PAM dist: 7: indel length: 0: CRISPR gRNA ID: GF-CCELg9-382: [crRNA sequence]:
crRNA sequence: CCTGGACACATACAGTGAGGAGG (SEQ ID NO: 1846):

TABLE 7-continued

Illustrative guide RNA sequences for polypeptides comprising Cas9

SpgRNA: attctaatacgactcactataggCCTGGACACATACAGTGAGGgttttagagctagaaatagcaagttaaaataaggctagtccgt
tatcaacttgaaaaagtggcaccgagtcggtgc (SEQ ID NO: 1847): [Target gene information]: Gene ID: 3718: Symbol:
JAK3: Ensembl Transcript ID: ENST00000527670.1: GRCh: 37: Chr: 19: [Target cancer mutation
information]: mut start: 17951048: mut end: 17951048: mut class: Silent: mut type: SNP: ref seq: G: mut
seq: T: mut aa: p.V415V: mutation info source: CCLE: ref target(-10 +10):
CCTGGACACAGACAGTGAGGA (SEQ ID NO: 533): mut target(-10 +10):
CCTGGACACATACAGTGAGGA (SEQ ID NO: 534): [Model Cell line information]: cell: NCIH1975:
cancer type: LUNG: PAM dist: 10: indel length: 0: CRISPR gRNA ID: GF-CCELg9-383: [crRNA sequence]:
crRNA sequence: CCTCCTCACTGTATGTGTCCAGG (SEQ ID NO: 1848):
SpgRNA: attctaatacgactcactataggCCTCCTCACTGTATGTGTCCGgttttagagctagaaatagcaagttaaaataaggctagtccgtta
tcaacttgaaaaagtggcaccgagtcggtgc (SEQ ID NO: 1849): [Target gene information]: Gene ID: 3718: Symbol:
JAK3: Ensembl Transcript ID: ENST00000527670.1: GRCh: 37: Chr: 19: [Target cancer mutation
information]: mut start: 17951048: mut end: 17951048: mut class: Silent: mut type: SNP: ref seq: G: mut
seq: T: mut aa: p.V415V: mutation info source: CCLE: ref target(-10 +10):
CCTGGACACAGACAGTGAGGA (SEQ ID NO: 533): mut target(-10 +10):
CCTGGACACATACAGTGAGGA (SEQ ID NO: 534): [Model Cell line information]: cell: NCIH1975:
cancer type: LUNG: PAM dist: 8: indel length: 0: CRISPR gRNA ID: GF-CCELg9-384: [crRNA sequence]:
crRNA sequence: CTCACTGTATGTGTCCAGGTCGG (SEQ ID NO: 1850):
SpgRNA: attctaatacgactcactataggCTCACTGTATGTGTCCAGGTCGGgttttagagctagaaatagcaagttaaaataaggctagtccgtt
atcaacttgaaaaagtggcaccgagtcggtgc (SEQ ID NO: 1851): [Target gene information]: Gene ID: 3718: Symbol:
JAK3: Ensembl Transcript ID: ENST00000527670.1: GRCh: 37: Chr: 19: [Target cancer mutation
information]: mut start: 17951048: mut end: 17951048: mut class: Silent: mut type: SNP: ref seq: G: mut
seq: T: mut aa: p.V415V: mutation info source: CCLE: ref target(-10 +10):
CCTGGACACAGACAGTGAGGA (SEQ ID NO: 533): mut target(-10 +10):
CCTGGACACATACAGTGAGGA (SEQ ID NO: 534): [Model Cell line information]: cell: NCIH1975:
cancer type: LUNG: PAM dist: 12: indel length: 0: CRISPR gRNA ID: GF-CCELg9-385: [crRNA sequence]:
crRNA sequence: GAAATGTCATCCGACTCAGCTGG (SEQ ID NO: 1852):
SpgRNA: attctaatacgactcactataggGAAATGTCATCCGACTCAGCg0nagagctagaaatagcaagttaaaataaggctagtccgtt
atcaacttgaaaaagtggcaccgagtcggtgc (SEQ ID NO: 1853): [Target gene information]: Gene ID: 3718: Symbol:
JAK3: Ensembl Transcript ID: ENST00000527670.1: GRCh: 37: Chr: 19: [Target cancer mutation
information]: mut start: 17949112: mut end: 17949112: mut class: Missense Mutation: mut type: SNP: ref
seq: T: mut seq: C: mut aa: p.Q510R: mutation info source: CCLE: ref target(-10 +10):
AAATGTCATCTGACTCAGCTG (SEQ ID NO: 1854): mut target(-10 +10):
AAATGTCATCCGACTCAGCTG (SEQ ID NO: 1855): [Model Cell line information]: cell: 5W1990:
cancer type: PANCREAS: PAM dist: 9: indel length: 0: CRISPR gRNA ID: GF-CCELg9-386: [crRNA
sequence]: crRNA sequence: TCATCCGACTCAGCTGGTATTGG (SEQ ID NO: 1856):
SpgRNA: attctaatacgactcactataggTCATCCGACTCAGCTGGTATg0nagagctagaaatagcaagttaaaataaggctagtccgtt
atcaacttgaaaaagtggcaccgagtcggtgc (SEQ ID NO: 1857): [Target gene information]: Gene ID: 3718: Symbol:
JAK3: Ensembl Transcript ID: ENST00000527670.1: GRCh: 37: Chr: 19: [Target cancer mutation
information]: mut start: 17949112: mut end: 17949112: mut class: Missense Mutation: mut type: SNP: ref
seq: T: mut seq: C: mut aa: p.Q510R: mutation info source: CCLE: ref target(-10 +10):
AAATGTCATCTGACTCAGCTG (SEQ ID NO: 1854): mut target(-10 +10):
AAATGTCATCCGACTCAGCTG (SEQ ID NO: 1855): [Model Cell line information]: cell: 5W1990:
cancer type: PANCREAS: PAM dist: 15: indel length: 0: CRISPR gRNA ID: GF-CCELg9-387: [crRNA
sequence]: crRNA sequence: CATCCGACTCAGCTGGTATTGGG (SEQ ID NO: 1858):
SpgRNA: attctaatacgactcactataggCATCCGACTCAGCTGGTATT0nagagctagaaatagcaagttaaaataaggctagtccgtt
atcaacttgaaaaagtggcaccgagtcggtgc (SEQ ID NO: 1859): [Target gene information]: Gene ID: 3718: Symbol:
JAK3: Ensembl Transcript ID: ENST00000527670.1: GRCh: 37: Chr: 19: [Target cancer mutation
information]: mut start: 17949112: mut end: 17949112: mut class: Missense Mutation: mut type: SNP: ref
seq: T: mut seq: C: mut aa: p.Q510R: mutation info source: CCLE: ref target(-10 +10):
AAATGTCATCTGACTCAGCTG (SEQ ID NO: 1854): mut target(-10 +10):
AAATGTCATCCGACTCAGCTG (SEQ ID NO: 1855): [Model Cell line information]: cell: 5W1990:
cancer type: PANCREAS: PAM dist: 16: indel length: 0: CRISPR gRNA ID: GF-CCELg9-388: [crRNA
sequence]: crRNA sequence: AATCCCAATACCAGCTGAGTCGG (SEQ ID NO: 1860):
SpgRNA: attctaatacgactcactataggAATCCCAATACCAGCTGAGTg0nagagctagaaatagcaagttaaaataaggctagtccgtt
atcaacttgaaaaagtggcaccgagtcggtgc (SEQ ID NO: 1861): [Target gene information]: Gene ID: 3718: Symbol:
JAK3: Ensembl Transcript ID: ENST00000527670.1: GRCh: 37: Chr: 19: [Target cancer mutation
information]: mut start: 17949112: mut end: 17949112: mut class: Missense Mutation: mut type: SNP: ref
seq: T: mut seq: C: mut aa: p.Q510R: mutation info source: CCLE: ref target(-10 +10):
AAATGTCATCTGACTCAGCTG (SEQ ID NO: 1854): mut target(-10 +10):
AAATGTCATCCGACTCAGCTG (SEQ ID NO: 1855): [Model Cell line information]: cell: 5W1990:
cancer type: PANCREAS: PAM dist: -1: indel length: 0: CRISPR gRNA ID: GF-CCELg9-389: [crRNA
sequence]: crRNA sequence: GGGGATACAGCAGGAAGTGAAGG (SEQ ID NO: 1862):
SpgRNA: attctaatacgactcactataggGGGGATACAGCAGGAAGTGAg0nagagctagaaatagcaagttaaaataaggctagtccg
ttatcaacttgaaaaagtggcaccgagtcggtgc (SEQ ID NO: 1863): [Target gene information]: Gene ID: 3718:
Symbol: JAK3: Ensembl Transcript ID: EN5T00000527670.1: GRCh: 37: Chr: 19: [Target cancer mutation
information]: mut start: 17950316: mut end: 17950316: mut class: Missense Mutation: mut type: SNP: ref
seq: G: mut seq: A: mut aa: p.L471F: mutation info source: CCLE: ref target(-10 +10):
CAGGAAGTGAGGGTCACTGCC (SEQ ID NO: 1864): mut target(-10 +10):
CAGGAAGTGAAGGTCACTGCC (SEQ ID NO: 1865): [Model Cell line information]: cell: NCIH1573:
cancer type: LUNG: PAM dist: 0: indel length: 0: CRISPR gRNA ID: GF-CCELg9-390: [crRNA sequence]:
crRNA sequence: CGGACTGGTAGCAGCTTGTCTGG (SEQ ID NO: 1866):
SpgRNA: attctaatacgactcactataggCGGACTGGTAGCAGCTTGTCgttttagagctagaaatagcaagttaaaataaggctagtccgtt
atcaacttgaaaaagtggcaccgagtcggtgc (SEQ ID NO: 1867): [Target gene information]: Gene ID: 3791: Symbol:
KDR: Ensembl Transcript ID: EN5T00000263923.4: GRCh: 37: Chr: 4: [Target cancer mutation
information]: mut start: 55946269: mut end: 55946269: mut class: Missense Mutation: mut type: SNP: ref
seq: C: mut seq: A: mut aa: p.G1304C: mutation info source: CCLE: ref target(-10 +10):
GACTGGTAGCCCGCTTGTCTGG (SEQ ID NO: 1868): mut target(-10 +10):

TABLE 7-continued

Illustrative guide RNA sequences for polypeptides comprising Cas9

GACTGGTAGCAGCTTGTCTGG (SEQ ID NO: 1869): [Model Cell line information]: cell: NCIH460:
cancer type: LUNG: PAM dist: 8: indel length: 0: CRISPR gRNA ID: GF-CCELg9-391: [crRNA sequence]:
crRNA sequence: CAGACAAGCTGCTACCAGTCCGG (SEQ ID NO: 1870):
SpgRNA: attctaatacgactcactataggCAGACAAGCTGCTACCAGTCgttttagagctagaaatagcaagttaaaataaggctagtccgtt
atcaacttgaaaaagtggcaccgagtcggtgc (SEQ ID NO: 1871): [Target gene information]: Gene ID: 3791: Symbol:
KDR: Ensembl Transcript ID: EN5T00000263923.4: GRCh: 37: Chr: 4: [Target cancer mutation
information]: mut start: 55946269: mut end: 55946269: mut class: Missense Mutation: mut type: SNP: ref
seq: C: mut seq: A: mut aa: p.G1304C: mutation info source: CCLE: ref target(-10 +10):
GACTGGTAGCCGCTTGTCTGG (SEQ ID NO: 1868): mut target(-10 +10):
GACTGGTAGCAGCTTGTCTGG (SEQ ID NO: 1869): [Model Cell line information]: cell: NCIH460:
cancer type: LUNG: PAM dist: 11: indel length: 0: CRISPR gRNA ID: GF-CCELg9-392: [crRNA sequence]:
crRNA sequence: CCGCATCCTGCACCTCGAGCCGG (SEQ ID NO: 1872):
SpgRNA: attctaatacgactcactataggCCGCATCCTGCACCTCGAGCgttttagagctagaaatagcaagttaaaataaggctagtccgtt
atcaacttgaaaaagtggcaccgagtcggtgc (SEQ ID NO: 1873): [Target gene information]: Gene ID: 3791: Symbol:
KDR: Ensembl Transcript ID: EN5T00000263923.4: GRCh: 37: Chr: 4: [Target cancer mutation
information]: mut start: 55991456: mut end: 55991456: mut class: Missense Mutation: mut type: SNP: ref
seq: T: mut seq: C: mut aa: p.Q2R: mutation info source: CCLE: ref target(-10 +10):
CACCTTGCTCTGCATCCTGCA (SEQ ID NO: 541): mut target(-10 +10):
CACCTTGCTCCGCATCCTGCA (SEQ ID NO: 542): [Model Cell line information]: cell: NCIH2126:
cancer type: LUNG: PAM dist: 19: indel length: 0: CRISPR gRNA ID: GF-CCELg9-393: [crRNA sequence]:
crRNA sequence: CGCATCCTGCACCTCGAGCCGGG (SEQ ID NO: 1874):
SpgRNA: attctaatacgactcactataggCGCATCCTGCACCTCGAGCCgttttagagctagaaatagcaagttaaaataaggctagtccgtt
atcaacttgaaaaagtggcaccgagtcggtgc (SEQ ID NO: 1875): [Target gene information]: Gene ID: 3791: Symbol:
KDR: Ensembl Transcript ID: EN5T00000263923.4: GRCh: 37: Chr: 4: [Target cancer mutation
information]: mut start: 55991456: mut end: 55991456: mut class: Missense Mutation: mut type: SNP: ref
seq: T: mut seq: C: mut aa: p.Q2R: mutation info source: CCLE: ref target(-10 +10):
CACCTTGCTCTGCATCCTGCA (SEQ ID NO: 541): mut target(-10 +10):
CACCTTGCTCCGCATCCTGCA (SEQ ID NO: 542): [Model Cell line information]: cell: NCIH2126:
cancer type: LUNG: PAM dist: 20: indel length: 0: CRISPR gRNA ID: GF-CCELg9-394: [crRNA sequence]:
crRNA sequence: GAGGTGCAGGATGCGGAGCAAGG (SEQ ID NO: 1876):
SpgRNA: attctaatacgactcactataggGAGGTGCAGGATGCGGAGCAgttttagagctagaaatagcaagttaaaataaggctagtccgt
tatcaacttgaaaaagtggcaccgagtcggtgc (SEQ ID NO: 1877): [Target gene information]: Gene ID: 3791: Symbol:
KDR: Ensembl Transcript ID: EN5T00000263923.4: GRCh: 37: Chr: 4: [Target cancer mutation
information]: mut start: 55991456: mut end: 55991456: mut class: Missense Mutation: mut type: SNP: ref
seq: T: mut seq: C: mut aa: p.Q2R: mutation info source: CCLE: ref target(-10 +10):
CACCTTGCTCTGCATCCTGCA (SEQ ID NO: 541): mut target(-10 +10):
CACCTTGCTCCGCATCCTGCA (SEQ ID NO: 542): [Model Cell line information]: cell: NCIH2126:
cancer type: LUNG: PAM dist: 6: indel length: 0: CRISPR gRNA ID: GF-CCELg9-395: [crRNA sequence]:
crRNA sequence: GATGCGGAGCAAGGTGCTGCTGG (SEQ ID NO: 1878):
SpgRNA: attctaatacgactcactataggGATGCGGAGCAAGGTGCTGCTGGgttttagagctagaaatagcaagttaaaataaggctagtccgt
tatcaacttgaaaaagtggcaccgagtcggtgc (SEQ ID NO: 1879): [Target gene information]: Gene ID: 3791: Symbol:
KDR: Ensembl Transcript ID: ENST00000263923.4: GRCh: 37: Chr: 4: [Target cancer mutation
information]: mut start: 55991456: mut end: 55991456: mut class: Missense Mutation: mut type: SNP: ref
seq: T: mut seq: C: mut aa: p.Q2R: mutation info source: CCLE: ref target(-10 +10):
CACCTTGCTCTGCATCCTGCA (SEQ ID NO: 541): mut target(-10 +10):
CACCTTGCTCCGCATCCTGCA (SEQ ID NO: 542): [Model Cell line information]: cell: NCIH2126:
cancer type: LUNG: PAM dist: 15: indel length: 0: CRISPR gRNA ID: GF-CCELg9-396: [crRNA sequence]:
crRNA sequence: CCGGCTCGAGGTGCAGGATGCGG (SEQ ID NO: 1880):
SpgRNA: attctaatacgactcactataggCCGGCTCGAGGTGCAGGATGgttttagagctagaaatagcaagttaaaataaggctagtccgt
tatcaacttgaaaaagtggcaccgagtcggtgc (SEQ ID NO: 1881): [Target gene information]: Gene ID: 3791: Symbol:
KDR: Ensembl Transcript ID: EN5T00000263923.4: GRCh: 37: Chr: 4: [Target cancer mutation
information]: mut start: 55991456: mut end: 55991456: mut class: Missense Mutation: mut type: SNP: ref
seq: T: mut seq: C: mut aa: p.Q2R: mutation info source: CCLE: ref target(-10 +10):
CACCTTGCTCTGCATCCTGCA (SEQ ID NO: 541): mut target(-10 +10):
CACCTTGCTCCGCATCCTGCA (SEQ ID NO: 542): [Model Cell line information]: cell: NCIH2126:
cancer type: LUNG: PAM dist: -1: indel length: 0: CRISPR gRNA ID: GF-CCELg9-397: [crRNA sequence]:
crRNA sequence: AGCAGCCCGCGGTGTAGATCAGG (SEQ ID NO: 1882):
SpgRNA: attctaatacgactcactataggAGCAGCCCGCGGTGTAGATCgttttagagctagaaatagcaagttaaaataaggctagtccgtt
atcaacttgaaaaagtggcaccgagtcggtgc (SEQ ID NO: 1883): [Target gene information]: Gene ID: 9817: Symbol:
KEAP1: Ensembl Transcript ID: ENST00000171111.5: GRCh: 37: Chr: 19: [Target cancer mutation
information]: mut start: 10602581: mut end: 10602581: mut class: Missense Mutation: mut type: SNP: ref
seq: C: mut seq: A: mut aa: p.G333C: mutation info source: CCLE: ref target(-10 +10):
CGGAAGTAGCCGCCCGCGGTG (SEQ ID NO: 1884): mut target(-10 +10):
CGGAAGTAGCAGCCCGCGGTG (SEQ ID NO: 1885): [Model Cell line information]: cell: A549: cancer
type: LUNG: PAM dist: 17: indel length: 0: CRISPR gRNA ID: GF-CCELg9-398: [crRNA sequence]:
crRNA sequence: CTGTCGGAAGTAGCAGCCCGCGG (SEQ ID NO: 1886):
SpgRNA: attctaatacgactcactataggCTGTCGGAAGTAGCAGCCCGgttttagagctagaaatagcaagttaaaataaggctagtccgtt
atcaacttgaaaaagtggcaccgagtcggtgc (SEQ ID NO: 1887): [Target gene information]: Gene ID: 9817: Symbol:
KEAP1: Ensembl Transcript ID: ENST00000171111.5: GRCh: 37: Chr: 19: [Target cancer mutation
information]: mut start: 10602581: mut end: 10602581: mut class: Missense Mutation: mut type: SNP: ref
seq: C: mut seq: A: mut aa: p.G333C: mutation info source: CCLE: ref target(-10 +10):
CGGAAGTAGCCGCCCGCGGTG (SEQ ID NO: 1884): mut target(-10 +10):
CGGAAGTAGCAGCCCGCGGTG (SEQ ID NO: 1885): [Model Cell line information]: cell: A549: cancer
type: LUNG: PAM dist: 6: indel length: 0: CRISPR gRNA ID: GF-CCELg9-399: [crRNA sequence]: crRNA
sequence: AGCCCGCGGTGTAGATCAGGCGG (SEQ ID NO: 1888):
SpgRNA: attctaatacgactcactataggAGCCCGCGGTGTAGATCAGGgttttagagctagaaatagcaagttaaaataaggctagtccgt
tatcaacttgaaaaagtggcaccgagtcggtgc (SEQ ID NO: 1889): [Target gene information]: Gene ID: 9817: Symbol:
KEAP1: Ensembl Transcript ID: ENST00000171111.5: GRCh: 37: Chr: 19: [Target cancer mutation TABLE 7-continued Illustrative guide RNA sequences for polypeptides comprising Cas9 information]: mut start: 10602581: mut end: 10602581: mut class: Missense Mutation: mut type: SNP: ref
seq: C: mut seq: A: mut aa: p.G333C: mutation info source: CCLE: ref target(-10 +10):
CGGAAGTAGCCGCCCGCGGTG (SEQ ID NO: 1884): mut target(-10 +10):
CGGAAGTAGCAGCCCGCGGTG (SEQ ID NO: 1885): [Model Cell line information]: cell: A549: cancer
type: LUNG: PAM dist: 20: indel length: 0: CRISPR gRNA ID: GF-CCELg9-400: [crRNA sequence]:
crRNA sequence: CACGGATAACGCTGTCGATCTGG (SEQ ID NO: 1890):
SpgRNA: attctaatacgactcactataggCACGGATAACGCTGTCGATCTGGgttttagagctagaaatagcaagttaaaataaggctagtccgtt
atcaacttgaaaaagtggcaccgagtcggtgc (SEQ ID NO: 1891): [Target gene information]: Gene ID: 9817: Symbol:
KEAP1: Ensembl Transcript ID: ENST00000171111.5: GRCh: 37: Chr: 19: [Target cancer mutation
information]: mut start: 10610208: mut end: 10610208: mut class: Missense Mutation: mut type: SNP: ref
seq: C: mut seq: T: mut aa: p.V168I: mutation info source: CCLE: ref target(-10 +10):
CAGGCACGGACAACGCTGTCG (SEQ ID NO: 1892): mut target(-10 +10):
CAGGCACGGATAACGCTGTCG (SEQ ID NO: 1893): [Model Cell line information]: cell: NCIH661:
cancer type: LUNG: PAM dist: 14: indel length: 0: CRISPR gRNA ID: GF-CCELg9-401: [crRNA sequence]:
crRNA sequence: TCAGGTGGTCCCGGCTGATGAGG (SEQ ID NO: 1894):
SpgRNA: attctaatacgactcactataggTCAGGTGGTCCCGGCTGATGGgttttagagctagaaatagcaagttaaaataaggctagtccgtt
atcaacttgaaaaagtggcaccgagtcggtgc (SEQ ID NO: 1895): [Target gene information]: Gene ID: 9817: Symbol:
KEAP1: Ensembl Transcript ID: ENST00000171111.5: GRCh: 37: Chr: 19: [Target cancer mutation
information]: mut start: 10602872: mut end: 10602872: mut class: Missense Mutation: mut type: SNP: ref
seq: C: mut seq: G: mut aa: p.D236H: mutation info source: CCLE: ref target(-10 +10):
ACGTTCAGGTCGTCCCGGCTG (SEQ ID NO: 1896): mut target(-10 +10):
ACGTTCAGGTGGTCCCGGCTG (SEQ ID NO: 1897): [Model Cell line information]: cell: NCIH460:
cancer type: LUNG: PAM dist: 14: indel length: 0: CRISPR gRNA ID: GF-CCELg9-402: [crRNA sequence]:
crRNA sequence: ACTCGCAGCGCACGTTCAGGTGG (SEQ ID NO: 1898):
SpgRNA: attctaatacgactcactataggACTCGCAGCGCACGTTCAGGgttttagagctagaaatagcaagttaaaataaggctagtccgtt
atcaacttgaaaaagtggcaccgagtcggtgc (SEQ ID NO: 1899): [Target gene information]: Gene ID: 9817: Symbol:
KEAP1: Ensembl Transcript ID: ENST00000171111.5: GRCh: 37: Chr: 19: [Target cancer mutation
information]: mut start: 10602872: mut end: 10602872: mut class: Missense Mutation: mut type: SNP: ref
seq: C: mut seq: G: mut aa: p.D236H: mutation info source: CCLE: ref target(-10 +10):
ACGTTCAGGTCGTCCCGGCTG (SEQ ID NO: 1896): mut target(-10 +10):
ACGTTCAGGTGGTCCCGGCTG (SEQ ID NO: 1897): [Model Cell line information]: cell: NCIH460:
cancer type: LUNG: PAM dist: -1: indel length: 0: CRISPR gRNA ID: GF-CCELg9-403: [crRNA sequence]:
crRNA sequence: AGCGCACGTTCAGGTGGTCCCGG (SEQ ID NO: 1900):
SpgRNA: attctaatacgactcactataggAGCGCACGTTCAGGTGGTCCgttttagagctagaaatagcaagttaaaataaggctagtccgtt
atcaacttgaaaaagtggcaccgagtcggtgc (SEQ ID NO: 1901): [Target gene information]: Gene ID: 9817: Symbol:
KEAP1: Ensembl Transcript ID: ENST00000171111.5: GRCh: 37: Chr: 19: [Target cancer mutation
information]: mut start: 10602872: mut end: 10602872: mut class: Missense Mutation: mut type: SNP: ref
seq: C: mut seq: G: mut aa: p.D236H: mutation info source: CCLE: ref target(-10 +10):
ACGTTCAGGTCGTCCCGGCTG (SEQ ID NO: 1896): mut target(-10 +10):
ACGTTCAGGTGGTCCCGGCTG (SEQ ID NO: 1897): [Model Cell line information]: cell: NCIH460:
cancer type: LUNG: PAM dist: 5: indel length: 0: CRISPR gRNA ID: GF-CCELg9-404: [crRNA sequence]:
crRNA sequence: CAGGTGGTCCCGGCTGATGAGGG (SEQ ID NO: 1902):
SpgRNA: attctaatacgactcactataggCAGGTGGTCCCGGCTGATGAgttttagagctagaaatagcaagttaaaataaggctagtccgtt
atcaacttgaaaaagtggcaccgagtcggtgc (SEQ ID NO: 1903): [Target gene information]: Gene ID: 9817: Symbol:
KEAP1: Ensembl Transcript ID: ENST00000171111.5: GRCh: 37: Chr: 19: [Target cancer mutation
information]: mut start: 10602872: mut end: 10602872: mut class: Missense Mutation: mut type: SNP: ref
seq: C: mut seq: G: mut aa: p.D236H: mutation info source: CCLE: ref target(-10 +10):
ACGTTCAGGTCGTCCCGGCTG (SEQ ID NO: 1896): mut target(-10 +10):
ACGTTCAGGTGGTCCCGGCTG (SEQ ID NO: 1897): [Model Cell line information]: cell: NCIH460:
cancer type: LUNG: PAM dist: 15: indel length: 0: CRISPR gRNA ID: GF-CCELg9-405: [crRNA sequence]:
crRNA sequence: CATGGAGATGGAGGGCGTGTAGG (SEQ ID NO: 1904):
SpgRNA: attctaatacgactcactataggCATGGAGATGGAGGGCGTGTgttttagagctagaaatagcaagttaaaataaggctagtccgt
tatcaacttgaaaaagtggcaccgagtcggtgc (SEQ ID NO: 1905): [Target gene information]: Gene ID: 9817: Symbol:
KEAP1: Ensembl Transcript ID: ENST00000171111.5: GRCh: 37: Chr: 19: [Target cancer mutation
information]: mut start: 10610283: mut end: 10610283: mut class: Missense Mutation: mut type: SNP: ref
seq: C: mut seq: G: mut aa: p.A143P: mutation info source: CCLE: ref target(-10 +10):
GAGATGGAGGCCGTGTAGGCG (SEQ ID NO: 1906): mut target(-10 +10):
GAGATGGAGGGCGTGTAGGCG (SEQ ID NO: 1907): [Model Cell line information]: cell: NCIH1573:
cancer type: LUNG: PAM dist: 6: indel length: 0: CRISPR gRNA ID: GF-CCELg9-406: [crRNA sequence]:
crRNA sequence: GCGTGTAGGCGAATTCAATGAGG (SEQ ID NO: 1908):
SpgRNA: attctaatacgactcactataggGCGTGTAGGCGAATTCAATGAGGgttttagagctagaaatagcaagttaaaataaggctagtccgtt
atcaacttgaaaaagtggcaccgagtcggtgc (SEQ ID NO: 1909): [Target gene information]: Gene ID: 9817: Symbol:
KEAP1: Ensembl Transcript ID: ENST00000171111.5: GRCh: 37: Chr: 19: [Target cancer mutation
information]: mut start: 10610283: mut end: 10610283: mut class: Missense Mutation: mut type: SNP: ref
seq: C: mut seq: G: mut aa: p.A143P: mutation info source: CCLE: ref target(-10 +10):
GAGATGGAGGCCGTGTAGGCG (SEQ ID NO: 1906): mut target(-10 +10):
GAGATGGAGGCCGTGTAGGCG (SEQ ID NO: 1907): [Model Cell line information]: cell: NCIH1573:
cancer type: LUNG: PAM dist: 20: indel length: 0: CRISPR gRNA ID: GF-CCELg9-407: [crRNA sequence]:
crRNA sequence: CTACACGCCCTCCATCTCCATGG (SEQ ID NO: 1910):
SpgRNA: attctaatacgactcactataggCTACACGCCCTCCATCTCCAgttttagagctagaaatagcaagttaaaataaggctagtccgtt
atcaacttgaaaaagtggcaccgagtcggtgc (SEQ ID NO: 1911): [Target gene information]: Gene ID: 9817: Symbol:
KEAP1: Ensembl Transcript ID: ENST00000171111.5: GRCh: 37: Chr: 19: [Target cancer mutation
information]: mut start: 10610283: mut end: 10610283: mut class: Missense Mutation: mut type: SNP: ref
seq: C: mut seq: G: mut aa: p.A143P: mutation info source: CCLE: ref target(-10 +10):
GAGATGGAGGCCGTGTAGGCG (SEQ ID NO: 1906): mut target(-10 +10):
GAGATGGAGGGCGTGTAGGCG (SEQ ID NO: 1907): [Model Cell line information]: cell: NCIH1573:
cancer type: LUNG: PAM dist: 13: indel length: 0: CRISPR gRNA ID: GF-CCELg9-408: [crRNA sequence]:
crRNA sequence: TACACGCCCTCCATCTCCATGGG (SEQ ID NO: 1912):

TABLE 7-continued

Illustrative guide RNA sequences for polypeptides comprising Cas9

SpgRNA: attctaatacgactcactataggTACACGCCCTCCATCTCCATgttttagagctagaaatagcaagttaaaataaggctagtccgtta
tcaacttgaaaaagtggcaccgagtcggtgc (SEQ ID NO: 1913): [Target gene information]: Gene ID: 9817: Symbol:
KEAP1: Ensembl Transcript ID: ENST00000171111.5: GRCh: 37: Chr: 19: [Target cancer mutation
information]: mut start: 10610283: mut end: 10610283: mut class: Missense Mutation: mut type: SNP: ref
seq: C: mut seq: G: mut aa: p.A143P: mutation info source: CCLE: ref target(-10 +10):
GAGATGGAGG<u>C</u>CGTGTAGGCG (SEQ ID NO: 1906): mut target(-10 +10):
GAGATGGAGG<u>G</u>CGTGTAGGCG (SEQ ID NO: 1907): [Model Cell line information]: cell: NCIH1573:
cancer type: LUNG: PAM dist: 14: indel length: 0: CRISPR gRNA ID: GF-CCELg9-409: [crRNA sequence]:
crRNA sequence: <u>A</u>CACGGCCCGCAGCAGCGCCTGG (SEQ ID NO: 1914):
SpgRNA: attctaatacgactcactataggACACGGCCCGCAGCAGCGCCgttttagagctagaaatagcaagttaaaataaggctagtccgt
tatcaacttgaaaaagtggcaccgagtcggtgc (SEQ ID NO: 1915): [Target gene information]: Gene ID: 9817: Symbol:
KEAP1: Ensembl Transcript ID: ENST00000171111.5: GRCh: 37: Chr: 19: [Target cancer mutation
information]: mut start: 10602764: mut end: 10602764: mut class: Missense Mutation: mut type: SNP: ref
seq: G: mut seq: A: mut aa: p.R272C: mutation info source: CCLE: ref target(-10 +10):
GAGTGGCAGC<u>G</u>CACGGCCCGC (SEQ ID NO: 1916): mut target(-10 +10):
GAGTGGCAGC<u>A</u>CACGGCCCGC (SEQ ID NO: 1917): [Model Cell line information]: cell: NCIH2126:
cancer type: LUNG: PAM dist: 20: indel length: 0: CRISPR gRNA ID: GF-CCELg9-410: [crRNA sequence]:
crRNA sequence: CGTCAACGAGTGGCAGC<u>A</u>CACGG (SEQ ID NO: 1918):
SpgRNA: attctaatacgactcactataggCGTCAACGAGTGGCAGCACAgttttagagctagaaatagcaagttaaaataaggctagtccgt
tatcaacttgaaaaagtggcaccgagtcggtgc (SEQ ID NO: 1919): [Target gene information]: Gene ID: 9817: Symbol:
KEAP1: Ensembl Transcript ID: ENST00000171111.5: GRCh: 37: Chr: 19: [Target cancer mutation
information]: mut start: 10602764: mut end: 10602764: mut class: Missense Mutation: mut type: SNP: ref
seq: G: mut seq: A: mut aa: p.R272C: mutation info source: CCLE: ref target(-10 +10):
GAGTGGCAGC<u>G</u>CACGGCCCGC (SEQ ID NO: 1916): mut target(-10 +10):
GAGTGGCAGC<u>A</u>CACGGCCCGC (SEQ ID NO: 1917): [Model Cell line information]: cell: NCIH2126:
cancer type: LUNG: PAM dist: 3: indel length: 0: CRISPR gRNA ID: GF-CCELg9-411: [crRNA sequence]:
crRNA sequence: TCCATTTATGTGTTTGTTAT<u>A</u>TAGG (SEQ ID NO: 1920):
SpgRNA: attctaatacgactcactataggTCCATTTATGTGTTTGTTATgttttagagctagaaatagcaagttaaaataaggctagtccgttat
caacttgaaaaagtggcaccgagtcggtgc (SEQ ID NO: 1921): [Target gene information]: Gene ID: 3815: Symbol:
KIT: Ensembl Transcript ID: ENST00000288135.5: GRCh: 37: Chr: 4: [Target cancer mutation information]
mut start: 55561945: mut end: 55561945: mut class: Missense Mutation: mut type: SNP: ref seq: G: mut
seq: T: mut aa: p.R112I: mutation info source: CCLE: ref target(-10 +10): GTGTTTGTTAGAGGTAAATGC
(SEQ ID NO: 545): mut target(-10 +10): GTGTTTGTTA<u>T</u>AGGTAAATGC (SEQ ID NO: 546): [Model
Cell line information]: cell: NCIH1573: cancer type: LUNG: PAM dist: 1: indel length: 0: CRISPR gRNA
ID: GF-CCELg9-412: [crRNA sequence]: crRNA sequence: GTTTGTTA<u>T</u>AGGTAAATGCTGG (SEQ ID
NO: 1922):
SpgRNA: attctaatacgactcactataggGTTTGTTATAGGTAAATGCTgttttagagctagaaatagcaagttaaaataaggctagtccgtt
atcaacttgaaaaagtggcaccgagtcggtgc (SEQ ID NO: 1923): [Target gene information]: Gene ID: 3815: Symbol:
KIT: Ensembl Transcript ID: ENST00000288135.5: GRCh: 37: Chr: 4: [Target cancer mutation information]:
mut start: 55561945: mut end: 55561945: mut class: Missense Mutation: mut type: SNP: ref seq: G: mut
seq: T: mut aa: p.R112I: mutation info source: CCLE: ref target(-10 +10): GTGTTTGTTAGAGGTAAATGC
(SEQ ID NO: 545): mut target(-10 +10): GTGTTTGTTA<u>T</u>AGGTAAATGC (SEQ ID NO: 546): [Model
Cell line information]: cell: NCIH1573: cancer type: LUNG: PAM dist: 12: indel length: 0: CRISPR gRNA
ID: GF-CCELg9-413: [crRNA sequence]: crRNA sequence: ACCT<u>A</u>TAACAAACACATAAATGG (SEQ ID
NO: 1924):
SpgRNA: attctaatacgactcactataggACCTATAACAAACACATAAAg agagctagaaatagcaagttaaaataaggctagtccgt
tatcaacttgaaaaagtggcaccgagtcggtgc (SEQ ID NO: 1925): [Target gene information]: Gene ID: 3815: Symbol:
KIT: Ensembl Transcript ID: ENST00000288135.5: GRCh: 37: Chr: 4: [Target cancer mutation information]:
mut start: 55561945: mut end: 55561945: mut class: Missense Mutation: mut type: SNP: ref seq: G: mut
seq: T: mut aa: p.R112I: mutation info source: CCLE: ref target(-10 +10): GTGTTTGTTA<u>G</u>AGGTAAATGC
(SEQ ID NO: 545): mut target(-10 +10): GTGTTTGTTA<u>T</u>AGGTAAATGC (SEQ ID NO: 546): [Model
Cell line information]: cell: NCIH1573: cancer type: LUNG: PAM dist: 16: indel length: 0: CRISPR gRNA
ID: GF-CCELg9-414: [crRNA sequence]: crRNA sequence: AACTCCTC<u>T</u>GTCTCTCTCCGAGG (SEQ ID
NO: 1926):
SpgRNA: attctaatacgactcactataggAACTCCTCTGTCTCTCTCCGg agagctagaaatagcaagttaaaataaggctagtccgtta
tcaacttgaaaaagtggcaccgagtcggtgc (SEQ ID NO: 1927): [Target gene information]: Gene ID: 9314: Symbol:
KLF4: Ensembl Transcript ID: EN5T00000374672.4: GRCh: 37: Chr: 9: [Target cancer mutation
information]: mut start: 110250387: mut end: 110250387: mut class: Silent: mut type: SNP: ref seq: G: mut
seq: T: mut aa: p.T96T: mutation info source: CCLE: ref target(-10 +10): TGAACTCCTCGGTCTCTCTCC
(SEQ ID NO: 1928): mut target(-10 +10): TGAACTCCTCTGTCTCTCTCC (SEQ ID NO: 1929): [Model
Cell line information]: cell: NCIH1437: cancer type: LUNG: PAM dist: 12: indel length: 0: CRISPR gRNA
ID: GF-CCELg9-415: crRNA sequence: CCTC<u>T</u>GTCTCTCTCCGAGGTAGG (SEQ ID
NO: 1930):
SpgRNA: attctaatacgactcactataggCCTCTGTCTCTCTCCGAGGTgttttagagctagaaatagcaagttaaaataaggctagtccgtta
tcaacttgaaaaagtggcaccgagtcggtgc (SEQ ID NO: 1931): [Target gene information]: Gene ID: 9314: Symbol:
KLF4: Ensembl Transcript ID: EN5T00000374672.4: GRCh: 37: Chr: 9: [Target cancer mutation
information]: mut start: 110250387: mut end: 110250387: mut class: Silent: mut type: SNP: ref seq: G: mut
seq: T: mut aa: p.T96T: mutation info source: CCLE: ref target(-10 +10): TGAACTCCTC<u>G</u>GTCTCTCTCC
(SEQ ID NO: 1928): mut target(-10 +10): TGAACTCCTC<u>T</u>GTCTCTCTCC (SEQ ID NO: 1929): [Model
Cell line information]: cell: NCIH1437: cancer type: LUNG: PAM dist: 16: indel length: 0: CRISPR gRNA
ID: GF-CCELg9-416: [crRNA sequence]: crRNA sequence: CTC<u>T</u>GTCTCTCTCCGAGGTAGGG (SEQ ID
NO: 1932):
SpgRNA: attctaatacgactcactataggCTCTGTCTCTCTCCGAGGTAg agagctagaaatagcaagttaaaataaggctagtccgtta
tcaacttgaaaaagtggcaccgagtcggtgc (SEQ ID NO: 1933): [Target gene information]: Gene ID: 9314: Symbol:
KLF4: Ensembl Transcript ID: EN5T00000374672.4: GRCh: 37: Chr: 9: [Target cancer mutation
information]: mut start: 110250387: mut end: 110250387: mut class: Silent: mut type: SNP: ref seq: G: mut
seq: T: mut aa: p.T96T: mutation info source: CCLE: ref target(-10 +10): TGAACTCCTC<u>G</u>GTCTCTCTCC
(SEQ ID NO: 1928): mut target(-10 +10): TGAACTCCTC<u>T</u>GTCTCTCTCC (SEQ ID NO: 1929): [Model TABLE 7-continued Illustrative guide RNA sequences for polypeptides comprising Cas9

Cell line information]: cell: NCIH1437: cancer type: LUNG: PAM dist: 17: indel length: 0: CRISPR gRNA
ID: GF-CCELg9-417: [crRNA sequence]: crRNA sequence: TCTGTCTCTCTCCGAGGTAGGGG (SEQ ID
NO: 1934):
SpgRNA: attctaatacgactcactataggTCTGTCTCTCTCCGAGGTAGgttttagagctagaaatagcaagttaaaataaggctagtccgtta
tcaacttgaaaaagtggcaccgagtcggtgc (SEQ ID NO: 1935): [Target gene information]: Gene ID: 9314: Symbol:
KLF4: Ensembl Transcript ID: EN5T00000374672.4: GRCh: 37: Chr: 9: [Target cancer mutation
information]: mut start: 110250387: mut end: 110250387: mut class: Silent: mut type: SNP: ref seq: G: mut
seq: T: mut aa: p.T96T: mutation info source: CCLE: ref target(-10 +10): TGAACTCCTCGGTCTCTCTCC
(SEQ ID NO: 1928): mut target(-10 +10): TGAACTCCTCTGTCTCTCTCC (SEQ ID NO: 1929): [Model
Cell line information]: cell: NCIH1437: cancer type: LUNG: PAM dist: 18: indel length: 0: CRISPR gRNA
ID: GF-CCELg9-418: [crRNA sequence]: crRNA sequence: CCTACCTCGGAGAGAGACAGAGG (SEQ ID
NO: 1936):
SpgRNA: attctaatacgactcactataggCCTACCTCGGAGAGAGACAGGgliftagagctagaaatagcaagttaaaataaggctagtccgt
tatcaacttgaaaaagtggcaccgagtcggtgc (SEQ ID NO: 193 7): [Target gene information]: Gene ID: 9314: Symbol:
KLF4: Ensembl Transcript ID: EN5T00000374672.4: GRCh: 37: Chr: 9: [Target cancer mutation
information]: mut start: 110250387: mut end: 110250387: mut class: Silent: mut type: SNP: ref seq: G: mut
seq: T: mut aa: p.T96T: mutation info source: CCLE: ref target(-10 +10): TGAACTCCTCGGTCTCTCTCC
(SEQ ID NO: 1928): mut target(-10 +10): TGAACTCCTCTGTCTCTCTCC (SEQ ID NO: 1929): [Model
Cell line information]: cell: NCIH1437: cancer type: LUNG: PAM dist: 2: indel length: 0: CRISPR gRNA
ID: GF-CCELg9-419: [crRNA sequence]: crRNA sequence: AGAGGAGTTCAACGATCTCCTGG (SEQ ID
NO: 1938):
SpgRNA: attctaatacgactcactataggAGAGGAGTTCAACGATCTCCgttttagagctagaaatagcaagttaaaataaggctagtccgtt
atcaacttgaaaaagtggcaccgagtcggtgc (SEQ ID NO: 193 9): [Target gene information]: Gene ID: 9314: Symbol:
KLF4: Ensembl Transcript ID: EN5T00000374672.4: GRCh: 37: Chr: 9: [Target cancer mutation
information]: mut start: 110250387: mut end: 110250387: mut class: Silent: mut type: SNP: ref seq: G: mut
seq: T: mut aa: p.T96T: mutation info source: CCLE: ref target(-10 +10): TGAACTCCTCGGTCTCTCTCC
(SEQ ID NO: 1928): mut target(-10 +10): TGAACTCCTCTGTCTCTCTCC (SEQ ID NO: 1929): [Model
Cell line information]: cell: NCIH1437: cancer type: LUNG: PAM dist: 20: indel length: 0: CRISPR gRNA
ID: GF-CCELg9-420: [crRNA sequence]: crRNA sequence: TAAGAAAAAATTCCAGCAGATGG (SEQ ID
NO: 102):
SpgRNA: attctaatacgactcactataggTAAGAAAAAATTCCAGCAGAgliftagagctagaaatagcaagttaaaataaggctagtccgt
tatcaacttgaaaaagtggcaccgagtcggtgc (SEQ ID NO: 110): [Target gene information]: Gene ID: 4297: Symbol:
KMT2A: Ensembl Transcript ID: EN5T00000389506.5: GRCh: 37: Chr: 11: [Target cancer mutation
informa-
tion]: mut start: 118354982: mut end: 118354983: mut class: Frame Shift Ins: mut type: INS: ref seq:
-: mut seq: A: mut aa: p.Q1391fs: mutation info source: CCLE: ref target(-10 +10): TAGTTCTAAG-
AAAAAATTCCA (SEQ ID NO: 105): mut target(-10 +10): TAGTTCTAAGAAAAAATTCCA (SEQ ID
NO: 95): [Model Cell line information]: cell: NCIH2126: cancer type: LUNG: PAM dist: 16: indel length: 1:
CRISPR gRNA ID: GF-CCELg9-421: [crRNA sequence]: crRNA sequence:
TTTCTTAGAACTATTGCCATTGG (SEQ ID NO: 1940):
SpgRNA: attctaatacgactcactataggTTTCTTAGAACTATTGCCATgliftagagctagaaatagcaagttaaaataaggctagtccgtta
tcaacttgaaaaagtggcaccgagtcggtgc (SEQ ID NO: 1941): [Target gene information]: Gene ID: 4297: Symbol:
KMT2A: Ensembl Transcript ID: EN5T00000389506.5: GRCh: 37: Chr: 11: [Target cancer mutation
informa-
tion]: mut start: 118354982: mut end: 118354983: mut class: Frame Shift Ins: mut type: INS: ref seq:
-: mut seq: A: mut aa: p.Q1391fs: mutation info source: CCLE: ref target(-10 +10): TAGTTCTAAG-
AAAAAATTCCA (SEQ ID NO: 105): mut target(-10 +10): TAGTTCTAAGAAAAAATTCCA (SEQ ID
NO: 95): [Model Cell line information]: cell: NCIH2126: cancer type: LUNG: PAM dist: 18: indel length: 1:
CRISPR gRNA ID: GF-CCELg9-422: [crRNA sequence]: crRNA sequence:
GCAATTGGGGGCTGAATTATAGG (SEQ ID NO: 1942):
SpgRNA: attctaatacgactcactataggGCAATTGGGGGCTGAATTATgliftagagctagaaatagcaagttaaaataaggctagtccgtt
atcaacttgaaaaagtggcaccgagtcggtgc (SEQ ID NO: 1943): [Target gene information]: Gene ID: 58508:
Symbol: KMT2C: Ensembl Transcript ID: ENST00000262189.6: GRCh: 37: Chr: 7: [Target cancer mutation
information]: mut start: 151860613: mut end: 151860613: mut class: Missense Mutation: mut type: SNP: ref
seq: C: mut seq: A: mut aa: p.R3350I: mutation info source: CCLE: ref target(-10 +10):
GGGCTGAATTCTAGGAGGATT (SEQ ID NO: 1944): mut target(-10 +10):
GGGCTGAATTATAGGAGGATT (SEQ ID NO: 1945): [Model Cell line information]: cell: A549: cancer
type: LUNG: PAM dist: 2: indel length: 0: CRISPR gRNA ID: GF-CCELg9-423: [crRNA sequence]: crRNA
sequence: ATTGGGGGCTGAATTATAGGAGG (SEQ ID NO: 1946):
SpgRNA: attctaatacgactcactataggATTGGGGGCTGAATTATAGGgttttagagctagaaatagcaagttaaaataaggctagtccgtt
atcaacttgaaaaagtggcaccgagtcggtgc (SEQ ID NO: 1947): [Target gene information]: Gene ID: 58508:
Symbol: KMT2C: Ensembl Transcript ID: ENST00000262189.6: GRCh: 37: Chr: 7: [Target cancer mutation
information]: mut start: 151860613: mut end: 151860613: mut class: Missense Mutation: mut type: SNP: ref
seq: C: mut seq: A: mut aa: p.R3350I: mutation info source: CCLE: ref target(-10 +10):
GGGCTGAATTCTAGGAGGATT (SEQ ID NO: 1944): mut target(-10 +10):
GGGCTGAATTATAGGAGGATT (SEQ ID NO: 1945): [Model Cell line information]: cell: A549: cancer
type: LUNG: PAM dist: 5: indel length: 0: CRISPR gRNA ID: GF-CCELg9-424: [crRNA sequence]: crRNA
sequence: GCTGAATTATAGGAGGATTGAGG (SEQ ID NO: 1948):
SpgRNA: attctaatacgactcactataggGCTGAATTATAGGAGGATTGgliftagagctagaaatagcaagttaaaataaggctagtccgtt
atcaacttgaaaaagtggcaccgagtcggtgc (SEQ ID NO: 1949): [Target gene information]: Gene ID: 58508:
Symbol: KMT2C: Ensembl Transcript ID: ENST00000262189.6: GRCh: 37: Chr: 7: [Target cancer mutation
information]: mut start: 151860613: mut end: 151860613: mut class: Missense Mutation: mut type: SNP: ref
seq: C: mut seq: A: mut aa: p.R3350I: mutation info source: CCLE: ref target(-10 +10):
GGGCTGAATTCTAGGAGGATT (SEQ ID NO: 1944): mut target(-10 +10):
GGGCTGAATTATAGGAGGATT (SEQ ID NO: 1945): [Model Cell line information]: cell: A549: cancer
type: LUNG: PAM dist: 12: indel length: 0: CRISPR gRNA ID: GF-CCELg9-425: [crRNA sequence]:
crRNA sequence: TTATAGGAGGATTGAGGGGCAGG (SEQ ID NO: 1950):

TABLE 7-continued

Illustrative guide RNA sequences for polypeptides comprising Cas9

```
SpgRNA: attctaatacgactcactataggTTATAGGAGGATTGAGGGGCgttttagagctagaaatagcaagttaaaataaggctagtccgt
tatcaacttgaaaaagtggcaccgagtcggtgc (SEQ ID NO: 1951): [Target gene information]: Gene ID: 58508:
Symbol: KMT2C: Ensembl Transcript ID: ENST00000262189.6: GRCh: 37: Chr: 7: [Target cancer mutation
information]: mut start: 151860613: mut end: 151860613: mut class: Missense Mutation: mut type: SNP: ref
seq: C: mut seq: A: mut aa: p.R3350I: mutation info source: CCLE: ref target(-10 +10):
GGGCTGAATTCTAGGAGGATT (SEQ ID NO: 1944): mut target(-10 +10):
GGGCTGAATTATAGGAGGATT (SEQ ID NO: 1945): [Model Cell line information]: cell: A549: cancer
type: LUNG: PAM dist: 18: indel length: 0: CRISPR gRNA ID: GF-CCELg9-426: [crRNA sequence]:
crRNA sequence: CTGAATTATAGGAGGATTGAGGG (SEQ ID NO: 1952):
SpgRNA: attctaatacgactcactataggCTGAATTATAGGAGGATTGAgintagagctagaaatagcaagttaaaataaggctagtccgtt
atcaacttgaaaaagtggcaccgagtcggtgc (SEQ ID NO: 1953): [Target gene information]: Gene ID: 58508:
Symbol: KMT2C: Ensembl Transcript ID: ENST00000262189.6: GRCh: 37: Chr: 7: [Target cancer mutation
information]: mut start: 151860613: mut end: 151860613: mut class: Missense Mutation: mut type: SNP: ref
seq: C: mut seq: A: mut aa: p.R3350I: mutation info source: CCLE: ref target(-10 +10):
GGGCTGAATTCTAGGAGGATT (SEQ ID NO: 1944): mut target(-10 +10):
GGGCTGAATTATAGGAGGATT (SEQ ID NO: 1945): [Model Cell line information]: cell: A549: cancer
type: LUNG: PAM dist: 13: indel length: 0: CRISPR gRNA ID: GF-CCELg9-427: [crRNA sequence]:
crRNA sequence: TGAATTATAGGAGGATTGAGGGG (SEQ ID NO: 1954):
SpgRNA: attctaatacgactcactataggTGAATTATAGGAGGATTGAGGGGgttttagagctagaaatagcaagttaaaataaggctagtccgtt
atcaacttgaaaaagtggcaccgagtcggtgc (SEQ ID NO: 1955): [Target gene information]: Gene ID: 58508:
Symbol: KMT2C: Ensembl Transcript ID: ENST00000262189.6: GRCh: 37: Chr: 7: [Target cancer mutation
information]: mut start: 151860613: mut end: 151860613: mut class: Missense Mutation: mut type: SNP: ref
seq: C: mut seq: A: mut aa: p.R3350I: mutation info source: CCLE: ref target(-10 +10):
GGGCTGAATTCTAGGAGGATT (SEQ ID NO: 1944): mut target(-10 +10):
GGGCTGAATTATAGGAGGATT (SEQ ID NO: 1945): [Model Cell line information]: cell: A549: cancer
type: LUNG: PAM dist: 14: indel length: 0: CRISPR gRNA ID: GF-CCELg9-428: [crRNA sequence]:
crRNA sequence: GTGGAAAATGTAGCAAACATTGG (SEQ ID NO: 1956):
SpgRNA: attctaatacgactcactataggGTGGAAAATGTAGCAAACATgttttagagctagaaatagcaagttaaaataaggctagtccgt
tatcaacttgaaaaagtggcaccgagtcggtgc (SEQ ID NO: 1957): [Target gene information]: Gene ID: 58508:
Symbol: KMT2C: Ensembl Transcript ID: ENST00000262189.6: GRCh: 37: Chr: 7: [Target cancer mutation
information]: mut start: 151919709: mut end: 151919709: mut class: Missense Mutation: mut type: SNP: ref
seq: C: mut seq: T: mut aa: p.D1128N: mutation info source: CCLE: ref target(-10 +10):
AAACCAATGTCTGCTACATTT (SEQ ID NO: 559): mut target(-10 +10):
AAACCAATGTTTGCTACATTT (SEQ ID NO: 560): [Model Cell line information]: cell: NCIH1437:
cancer type: LUNG: PAM dist: 5: indel length: 0: CRISPR gRNA ID: GF-CCELg9-429: [crRNA sequence]:
crRNA sequence: CACAGAGGACGATGTGGAACAGG (SEQ ID NO: 1958):
SpgRNA: attctaatacgactcactataggCACAGAGGACGATGTGGAACgttttagagctagaaatagcaagttaaaataaggctagtccgt
tatcaacttgaaaaagtggcaccgagtcggtgc (SEQ ID NO: 1959): [Target gene information]: Gene ID: 8085: Symbol:
KMT2D: Ensembl Transcript ID: EN5T00000301067.7: GRCh: 37: Chr: 12: [Target cancer mutation
information]: mut start: 49439909: mut end: 49439909: mut class: Silent: mut type: SNP: ref seq: C: mut
seq: T: mut aa: p.E1544E: mutation info source: CCLE: ref target(-10 +10):
CGGCTGCCTGCTCCACATCGT (SEQ ID NO: 1960): mut target(-10 +10):
CGGCTGCCTGTTCCACATCGT (SEQ ID NO: 1961): [Model Cell line information]: cell: NCIH1299:
cancer type: LUNG: PAM dist: 2: indel length: 0: CRISPR gRNA ID: GF-CCELg9-430: [crRNA sequence]:
crRNA sequence: GTGGAACAGGCAGCCGATGAAGG (SEQ ID NO: 1962):
SpgRNA: attctaatacgactcactataggGTGGAACAGGCAGCCGATGAgttttagagctagaaatagcaagttaaaataaggctagtccgt
tatcaacttgaaaaagtggcaccgagtcggtgc (SEQ ID NO: 1963): [Target gene information]: Gene ID: 8085: Symbol:
KMT2D: Ensembl Transcript ID: EN5T00000301067.7: GRCh: 37: Chr: 12: [Target cancer mutation
information]: mut start: 49439909: mut end: 49439909: mut class: Silent: mut type: SNP: ref seq: C: mut
seq: T: mut aa: p.E1544E: mutation info source: CCLE: ref target(-10 +10):
CGGCTGCCTGCTCCACATCGT (SEQ ID NO: 1960): mut target(-10 +10):
CGGCTGCCTGTTCCACATCGT (SEQ ID NO: 1961): [Model Cell line information]: cell: NCIH1299:
cancer type: LUNG: PAM dist: 15: indel length: 0: CRISPR gRNA ID: GF-CCELg9-431: [crRNA sequence]:
crRNA sequence: GATAGAGGCATCTCAAGTGCAGG (SEQ ID NO: 1964):
SpgRNA: attctaatacgactcactataggGATAGAGGCATCTCAAGTGCgttttagagctagaaatagcaagttaaaataaggctagtccgtt
atcaacttgaaaaagtggcaccgagtcggtgc (SEQ ID NO: 1965): [Target gene information]: Gene ID: 8085: Symbol:
KMT2D: Ensembl Transcript ID: EN5T00000301067.7: GRCh: 37: Chr: 12: [Target cancer mutation
information]: mut start: 49445865: mut end: 49445865: mut class: Missense Mutation: mut type: SNP: ref
seq: G: mut seq: A: mut aa: p.T534M: mutation info source: CCLE: ref target(-10 +10):
GGATAGAGGCGTCTCAAGTGC (SEQ ID NO: 1966): mut target(-10 +10):
GGATAGAGGCATCTCAAGTGC (SEQ ID NO: 1967): [Model Cell line information]: cell: NCIH1437:
cancer type: LUNG: PAM dist: 11: indel length: 0: CRISPR gRNA ID: GF-CCELg9-432: [crRNA sequence]:
crRNA sequence: GGCATCTCAAGTGCAGGAGATGG (SEQ ID NO: 1968):
SpgRNA: attctaatacgactcactataggGGCATCTCAAGTGCAGGAGgttttagagctagaaatagcaagttaaaataaggctagtccgt
tatcaacttgaaaaagtggcaccgagtcggtgc (SEQ ID NO: 1969): [Target gene information]: Gene ID: 8085: Symbol:
KMT2D: Ensembl Transcript ID: ENST00000301067.7: GRCh: 37: Chr: 12: [Target cancer mutation
information]: mut start: 49445865: mut end: 49445865: mut class: Missense Mutation: mut type: SNP: ref
seq: G: mut seq: A: mut aa: p.T534M: mutation info source: CCLE: ref target(-10 +10):
GGATAGAGGCGTCTCAAGTGC (SEQ ID NO: 1966): mut target(-10 +10):
GGATAGAGGCATCTCAAGTGC (SEQ ID NO: 1967): [Model Cell line information]: cell: NCIH1437:
cancer type: LUNG: PAM dist: 17: indel length: 0: CRISPR gRNA ID: GF-CCELg9-433: [crRNA sequence]:
crRNA sequence: GCATCTCAAGTGCAGGAGATGGG (SEQ ID NO: 1970):
SpgRNA: attctaatacgactcactataggGCATCTCAAGTGCAGGAGATggttttagagctagaaatagcaagttaaaataaggctagtccgtt
atcaacttgaaaaagtggcaccgagtcggtgc (SEQ ID NO: 1971): [Target gene information]: Gene ID: 8085: Symbol:
KMT2D: Ensembl Transcript ID: EN5T00000301067.7: GRCh: 37: Chr: 12: [Target cancer mutation
information]: mut start: 49445865: mut end: 49445865: mut class: Missense Mutation: mut type: SNP: ref
seq: G: mut seq: A: mut aa: p.T534M: mutation info source: CCLE: ref target(-10 +10):
GGATAGAGGCGTCTCAAGTGC (SEQ ID NO: 1966): mut target(-10 +10):
```

TABLE 7-continued

Illustrative guide RNA sequences for polypeptides comprising Cas9

GGATAGAGGCATCTCAAGTGC (SEQ ID NO: 1967): [Model Cell line information]: cell: NCIH1437:
cancer type: LUNG: PAM dist: 18: indel length: 0: CRISPR gRNA ID: GF-CCELg9-434: [crRNA sequence]:
crRNA sequence: CATCTCAAGTGCAGGAGATGGGG (SEQ ID NO: 1972):
SpgRNA: attctaatacgactcactataggCATCTCAAGTGCAGGAGATGGttttagagctagaaatagcaagttaaaataaggctagtccgtt
atcaacttgaaaaagtggcaccgagtcggtgc (SEQ ID NO: 1973): [Target gene information]: Gene ID: 8085: Symbol:
KMT2D: Ensembl Transcript ID: EN5T00000301067.7: GRCh: 37: Chr: 12: [Target cancer mutation
information]: mut start: 49445865: mut end: 49445865: mut class: Missense Mutation: mut type: SNP: ref
seq: G: mut seq: A: mut aa: p.T534M: mutation info source: CCLE: ref target(-10 +10):
GGATAGAGGCGTCTCAAGTGC (SEQ ID NO: 1966): mut target(-10 +10):
GGATAGAGGCATCTCAAGTGC (SEQ ID NO: 1967): [Model Cell line information]: cell: NCIH1437:
cancer type: LUNG: PAM dist: 19: indel length: 0: CRISPR gRNA ID: GF-CCELg9-435: [crRNA sequence]:
crRNA sequence: ATCTCAAGTGCAGGAGATGGGGG (SEQ ID NO: 1974):
SpgRNA: attctaatacgactcactataggATCTCAAGTGCAGGAGATGGGttttagagctagaaatagcaagttaaaataaggctagtccgt
tatcaacttgaaaaagtggcaccgagtcggtgc (SEQ ID NO: 1975): [Target gene information]: Gene ID: 8085: Symbol:
KMT2D: Ensembl Transcript ID: EN5T00000301067.7: GRCh: 37: Chr: 12: [Target cancer mutation
information]: mut start: 49445865: mut end: 49445865: mut class: Missense Mutation: mut type: SNP: ref
seq: G: mut seq: A: mut aa: p.T534M: mutation info source: CCLE: ref target(-10 +10):
GGATAGAGGCGTCTCAAGTGC (SEQ ID NO: 1966): mut target(-10 +10):
GGATAGAGGCATCTCAAGTGC (SEQ ID NO: 1967): [Model Cell line information]: cell: NCIH1437:
cancer type: LUNG: PAM dist: 20: indel length: 0: CRISPR gRNA ID: GF-CCELg9-436: [crRNA sequence]:
crRNA sequence: TTCTGCTGAGCACGCCCCACAGG (SEQ ID NO: 1976):
SpgRNA: attctaatacgactcactataggTTCTGCTGAGCACGCCCCACgttttagagctagaaatagcaagttaaaataaggctagtccgtt
atcaacttgaaaaagtggcaccgagtcggtgc (SEQ ID NO: 1977): [Target gene information]: Gene ID: 8085: Symbol:
KMT2D: Ensembl Transcript ID: EN5T00000301067.7: GRCh: 37: Chr: 12: [Target cancer mutation
information]: mut start: 49446825: mut end: 49446825: mut class: Missense Mutation: mut type: SNP: ref
seq: C: mut seq: A: mut aa: p.G329C: mutation info source: CCLE: ref target(-10 +10):
TCTGCTGAGCCCGCCCCACAG (SEQ ID NO: 1978): mut target(-10 +10):
TCTGCTGAGCACGCCCCACAG (SEQ ID NO: 1979): [Model Cell line information]: cell: NCIH1563:
cancer type: LUNG: PAM dist: 9: indel length: 0: CRISPR gRNA ID: GF-CCELg9-437: [crRNA sequence]:
crRNA sequence: CTGAGCACGCCCCACAGGCCGG (SEQ ID NO: 1980):
SpgRNA: attctaatacgactcactataggCTGAGCACGCCCCACAGGCCgttttagagctagaaatagcaagttaaaataaggctagtccgtt
atcaacttgaaaaagtggcaccgagtcggtgc (SEQ ID NO: 1981): [Target gene information]: Gene ID: 8085: Symbol:
KMT2D: Ensembl Transcript ID: EN5T00000301067.7: GRCh: 37: Chr: 12: [Target cancer mutation
information]: mut start: 49446825: mut end: 49446825: mut class: Missense Mutation: mut type: SNP: ref
seq: C: mut seq: A: mut aa: p.G329C: mutation info source: CCLE: ref target(-10 +10):
TCTGCTGAGCCCGCCCCACAG (SEQ ID NO: 1978): mut target(-10 +10):
TCTGCTGAGCACGCCCCACAG (SEQ ID NO: 1979): [Model Cell line information]: cell: NCIH1563:
cancer type: LUNG: PAM dist: 14: indel length: 0: CRISPR gRNA ID: GF-CCELg9-438: [crRNA sequence]:
crRNA sequence: GGCGGAGCACAGCAGCTCTCAGG (SEQ ID NO: 1982):
SpgRNA: attctaatacgactcactataggGGCGGAGCACAGCAGCTCTCAGgttttagagctagaaatagcaagttaaaataaggctagtccgt
tatcaacttgaaaaagtggcaccgagtcggtgc (SEQ ID NO: 1983): [Target gene information]: Gene ID: 8085: Symbol:
KMT2D: Ensembl Transcript ID: EN5T00000301067.7: GRCh: 37: Chr: 12: [Target cancer mutation
information]: mut start: 49434360: mut end: 49434360: mut class: Missense Mutation: mut type: SNP: ref
seq: A: mut seq: G: mut aa: p.L2398P: mutation info source: CCLE: ref target(-10 +10):
GCGAGGGGGCAGAGCACAGCA (SEQ ID NO: 1984): mut target(-10 +10):
GCGAGGGGGCGGAGCACAGCA (SEQ ID NO: 1985): [Model Cell line information]: cell: NCIH1573:
cancer type: LUNG: PAM dist: 17: indel length: 0: CRISPR gRNA ID: GF-CCELg9-439: [crRNA sequence]:
crRNA sequence: GAGGGCAGTGAGCGAGGGGCGG (SEQ ID NO: 1986):
SpgRNA: attctaatacgactcactataggGAGGGCAGTGAGCGAGGGGGgttttagagctagaaatagcaagttaaaataaggctagtccg
ttatcaacttgaaaaagtggcaccgagtcggtgc (SEQ ID NO: 1987): [Target gene information]: Gene ID: 8085:
Symbol: KMT2D: Ensembl Transcript ID: EN5T00000301067.7: GRCh: 37: Chr: 12: [Target cancer
mutation information]: mut start: 49434360: mut end: 49434360: mut class: Missense Mutation: mut type:
SNP: ref seq: A: mut seq: G: mut aa: p.L2398P: mutation info source: CCLE: ref target(-10 +10):
GCGAGGGGGCAGAGCACAGCA (SEQ ID NO: 1984): mut target(-10 +10):
GCGAGGGGGCGGAGCACAGCA (SEQ ID NO: 1985): [Model Cell line information]: cell: NCIH1573:
cancer type: LUNG: PAM dist: -1: indel length: 0: CRISPR gRNA ID: GF-CCELg9-440: [crRNA sequence]:
crRNA sequence: GCGGAGCACAGCAGCTCTCAGGG (SEQ ID NO: 1988):
SpgRNA: attctaatacgactcactataggGCGGAGCACAGCAGCTCTCAgttttagagctagaaatagcaagttaaaataaggctagtccgt
tatcaacttgaaaaagtggcaccgagtcggtgc (SEQ ID NO: 1989): [Target gene information]: Gene ID: 8085: Symbol:
KMT2D: Ensembl Transcript ID: EN5T00000301067.7: GRCh: 37: Chr: 12: [Target cancer mutation
information]: mut start: 49434360: mut end: 49434360: mut class: Missense Mutation: mut type: SNP: ref
seq: A: mut seq: G: mut aa: p.L2398P: mutation info source: CCLE: ref target(-10 +10):
GCGAGGGGGCAGAGCACAGCA (SEQ ID NO: 1984): mut target(-10 +10):
GCGAGGGGGCGGAGCACAGCA (SEQ ID NO: 1985): [Model Cell line information]: cell: NCIH1573:
cancer type: LUNG: PAM dist: 18: indel length: 0: CRISPR gRNA ID: GF-CCELg9-441: [crRNA sequence]:
crRNA sequence: CGGAGCACAGCAGCTCTCAGGGG (SEQ ID NO: 1990):
SpgRNA: attctaatacgactcactataggCGGAGCACAGCAGCTCTCAGgttttagagctagaaatagcaagttaaaataaggctagtccgt
tatcaacttgaaaaagtggcaccgagtcggtgc (SEQ ID NO: 1991): [Target gene information]: Gene ID: 8085: Symbol:
KMT2D: Ensembl Transcript ID: EN5T00000301067.7: GRCh: 37: Chr: 12: [Target cancer mutation
information]: mut start: 49434360: mut end: 49434360: mut class: Missense Mutation: mut type: SNP: ref
seq: A: mut seq: G: mut aa: p.L2398P: mutation info source: CCLE: ref target(-10 +10):
GCGAGGGGGCAGAGCACAGCA (SEQ ID NO: 1984): mut target(-10 +10):
GCGAGGGGGCGGAGCACAGCA (SEQ ID NO: 1985): [Model Cell line information]: cell: NCIH1573:
cancer type: LUNG: PAM dist: 19: indel length: 0: CRISPR gRNA ID: GF-CCELg9-442: [crRNA sequence]:
crRNA sequence: GGAGCACAGCAGCTCTCAGGGGG (SEQ ID NO: 1992):
SpgRNA: attctaatacgactcactataggGGAGCACAGCAGCTCTCAGGgttttagagctagaaatagcaagttaaaataaggctagtccgt
tatcaacttgaaaaagtggcaccgagtcggtgc (SEQ ID NO: 1993): [Target gene information]: Gene ID: 8085: Symbol:
KMT2D: Ensembl Transcript ID: EN5T00000301067.7: GRCh: 37: Chr: 12: [Target cancer mutation TABLE 7-continued Illustrative guide RNA sequences for polypeptides comprising Cas9 information]: mut start: 49434360: mut end: 49434360: mut class: Missense Mutation: mut type: SNP: ref
seq: A: mut seq: G: mut aa: p.L2398P: mutation info source: CCLE: ref target(-10 +10):
GCGAGGGGGCAGAGCACAGCA (SEQ ID NO: 1984): mut target(-10 +10):
GCGAGGGGGCGGAGCACAGCA (SEQ ID NO: 1985) [Model Cell line information]: cell: NCIH1573:
cancer type: LUNG: PAM dist: 20: indel length: 0: CRISPR gRNA ID: GF-CCELg9-443: [crRNA sequence]:
crRNA sequence: CGGGGTATGCTGCTCAGCAAAGG (SEQ ID NO: 1994):
SpgRNA: attctaatacgactcactataggCGGGGTATGCTGCTCAGCAAgttttagagctagaaatagcaagttaaaataaggctagtccgtt
atcaacttgaaaaagtggcaccgagtcggtgc (SEQ ID NO: 1995): [Target gene information]: Gene ID: 8085: Symbol:
KMT2D: Ensembl Transcript ID: EN5T00000301067.7: GRCh: 37: Chr: 12: [Target cancer mutation
information]: mut start: 49446729: mut end: 49446729: mut class: Missense Mutation: mut type: SNP: ref
seq: C: mut seq: A: mut aa: p.V361F: mutation info source: CCLE: ref target(-10 +10):
TGCTCAGCAACGGAGCGGATA (SEQ ID NO: 563): mut target(-10 +10):
TGCTCAGCAAAGGAGCGGATA (SEQ ID NO: 564): [Model Cell line information]: cell: NCIH1573:
cancer type: LUNG: PAM dist: 0: indel length: 0: CRISPR gRNA ID: GF-CCELg9-444: [crRNA sequence]:
crRNA sequence: TATGCTGCTCAGCAAAGGAGCGG (SEQ ID NO: 1996):
SpgRNA: attctaatacgactcactataggTATGCTGCTCAGCAAAGGAGgttttagagctagaaatagcaagttaaaataaggctagtccgtt
atcaacttgaaaaagtggcaccgagtcggtgc (SEQ ID NO: 1997): [Target gene information]: Gene ID: 8085: Symbol:
KMT2D: Ensembl Transcript ID: EN5T00000301067.7: GRCh: 37: Chr: 12: [Target cancer mutation
information]: mut start: 49446729: mut end: 49446729: mut class: Missense Mutation: mut type: SNP: ref
seq: C: mut seq: A: mut aa: p.V361F: mutation info source: CCLE: ref target(-10 +10):
TGCTCAGCAACGGAGCGGATA (SEQ ID NO: 563): mut target(-10 +10):
TGCTCAGCAAAGGAGCGGATA (SEQ ID NO: 564): [Model Cell line information]: cell: NCIH1573:
cancer type: LUNG: PAM dist: 5: indel length: 0: CRISPR gRNA ID: GF-CCELg9-445: [crRNA sequence]:
crRNA sequence: CTTTGCTGAGCAGCATACCCCGG (SEQ ID NO: 1998):
SpgRNA: attctaatacgactcactataggCTTTGCTGAGCAGCATACCCgttttagagctagaaatagcaagttaaaataaggctagtccgtt
atcaacttgaaaaagtggcaccgagtcggtgc (SEQ ID NO: 1999): [Target gene information]: Gene ID: 8085: Symbol:
KMT2D: Ensembl Transcript ID: EN5T00000301067.7: GRCh: 37: Chr: 12: [Target cancer mutation
information]: mut start: 49446729: mut end: 49446729: mut class: Missense Mutation: mut type: SNP: ref
seq: C: mut seq: A: mut aa: p.V361F: mutation info source: CCLE: ref target(-10 +10):
TGCTCAGCAACGGAGCGGATA (SEQ ID NO: 563): mut target(-10 +10):
TGCTCAGCAAAGGAGCGGATA (SEQ ID NO: 564): [Model Cell line information]: cell: NCIH1573:
cancer type: LUNG: PAM dist: 19: indel length: 0: CRISPR gRNA ID: GF-CCELg9-446: [crRNA sequence]:
crRNA sequence: GTGGTTCCCCAGGTTCAGACAGG (SEQ ID NO: 2000):
SpgRNA: attctaatacgactcactataggGTGGTTCCCCAGGTTCAGACgttttagagctagaaatagcaagttaaaataaggctagtccgtt
atcaacttgaaaaagtggcaccgagtcggtgc (SEQ ID NO: 2001): [Target gene information]: Gene ID: 8085: Symbol:
KMT2D: Ensembl Transcript ID: EN5T00000301067.7: GRCh: 37: Chr: 12: [Target cancer mutation
information]: mut start: 49444760: mut end: 49444760: mut class: Silent: mut type: SNP: ref seq: C: mut
seq: T: mut aa: p.E902E: mutation info source: CCLE: ref target(-10 +10):
GTTCCCCAGGCTCAGACAGGG (SEQ ID NO: 2002): mut target(-10 +10):
GTTCCCCAGGTTCAGACAGGG (SEQ ID NO: 2003): [Model Cell line information]: cell: NCIH2126:
cancer type: LUNG: PAM dist: 7: indel length: 0: CRISPR gRNA ID: GF-CCELg9-447: [crRNA sequence]:
crRNA sequence: TCCCCAGGTTCAGACAGGGCTGG (SEQ ID NO: 2004):
SpgRNA: attctaatacgactcactataggTCCCCAGGTTCAGACAGGGCgttttagagctagaaatagcaagttaaaataaggctagtccgtt
atcaacttgaaaaagtggcaccgagtcggtgc (SEQ ID NO: 2005): [Target gene information]: Gene ID: 8085: Symbol:
KMT2D: Ensembl Transcript ID: EN5T00000301067.7: GRCh: 37: Chr: 12: [Target cancer mutation
information]: mut start: 49444760: mut end: 49444760: mut class: Silent: mut type: SNP: ref seq: C: mut
seq: T: mut aa: p.E902E: mutation info source: CCLE: ref target(-10 +10):
GTTCCCCAGGCTCAGACAGGG (SEQ ID NO: 2002): mut target(-10 +10):
GTTCCCCAGGTTCAGACAGGG (SEQ ID NO: 2003): [Model Cell line information]: cell: NCIH2126:
cancer type: LUNG: PAM dist: 12: indel length: 0: CRISPR gRNA ID: GF-CCELg9-448: [crRNA sequence]:
crRNA sequence: TGGTTCCCCAGGTTCAGACAGGG (SEQ ID NO: 2006):
SpgRNA: attctaatacgactcactataggTGGTTCCCCAGGTTCAGACAGgttttagagctagaaatagcaagttaaaataaggctagtccgtt
atcaacttgaaaaagtggcaccgagtcggtgc (SEQ ID NO: 2007): [Target gene information]: Gene ID: 8085: Symbol:
KMT2D: Ensembl Transcript ID: EN5T00000301067.7: GRCh: 37: Chr: 12: [Target cancer mutation
information]: mut start: 49444760: mut end: 49444760: mut class: Silent: mut type: SNP: ref seq: C: mut
seq: T: mut aa: p.E902E: mutation info source: CCLE: ref target(-10 +10):
GTTCCCCAGGCTCAGACAGGG (SEQ ID NO: 2002): mut target(-10 +10):
GTTCCCCAGGTTCAGACAGGG (SEQ ID NO: 2003): [Model Cell line information]: cell: NCIH2126:
cancer type: LUNG: PAM dist: 8: indel length: 0: CRISPR gRNA ID: GF-CCELg9-449: [crRNA sequence]:
crRNA sequence: GAGCCAGCCCTGTCTGAACCTGG (SEQ ID NO: 2008):
SpgRNA: attctaatacgactcactataggGAGCCAGCCCTGTCTGAACCTGgttttagagctagaaatagcaagttaaaataaggctagtccgtt
atcaacttgaaaaagtggcaccgagtcggtgc (SEQ ID NO: 2009): [Target gene information]: Gene ID: 8085: Symbol:
KMT2D: Ensembl Transcript ID: EN5T00000301067.7: GRCh: 37: Chr: 12: [Target cancer mutation
information]: mut start: 49444760: mut end: 49444760: mut class: Silent: mut type: SNP: ref seq: C: mut
seq: T: mut aa: p.E902E: mutation info source: CCLE: ref target(-10 +10):
GTTCCCCAGGCTCAGACAGGG (SEQ ID NO: 2002): mut target(-10 +10):
GTTCCCCAGGTTCAGACAGGG (SEQ ID NO: 2003): [Model Cell line information]: cell: NCIH2126:
cancer type: LUNG: PAM dist: 3: indel length: 0: CRISPR gRNA ID: GF-CCELg9-450: [crRNA sequence]:
crRNA sequence: AGCCAGCCCTGTCTGAACCTGGG (SEQ ID NO: 2010):
SpgRNA: attctaatacgactcactataggAGCCAGCCCTGTCTGAACCTgttttagagctagaaatagcaagttaaaataaggctagtccgtt
atcaacttgaaaaagtggcaccgagtcggtgc (SEQ ID NO: 2011): [Target gene information]: Gene ID: 8085: Symbol:
KMT2D: Ensembl Transcript ID: EN5T00000301067.7: GRCh: 37: Chr: 12: [Target cancer mutation
information]: mut start: 49444760: mut end: 49444760: mut class: Silent: mut type: SNP: ref seq: C: mut
seq: T: mut aa: p.E902E: mutation info source: CCLE: ref target(-10 +10):
GTTCCCCAGGCTCAGACAGGG (SEQ ID NO: 2002): mut target(-10 +10):
GTTCCCCAGGTTCAGACAGGG (SEQ ID NO: 2003): [Model Cell line information]: cell: NCIH2126:
cancer type: LUNG: PAM dist: 4: indel length: 0: CRISPR gRNA ID: GF-CCELg9-451: [crRNA sequence]:
crRNA sequence: GCCAGCCCTGTCTGAACCTGGGG (SEQ ID NO: 2012):

TABLE 7-continued

Illustrative guide RNA sequences for polypeptides comprising Cas9

SpgRNA: attctaatacgactcactataggGCCAGCCCTGTCTGAACCTGgttttagagctagaaatagcaagttaaaataaggctagtccgtt
atcaacttgaaaaagtggcaccgagtcggtgc (SEQ ID NO: 2013): [Target gene information]: Gene ID: 8085: Symbol:
KMT2D: Ensembl Transcript ID: EN5T00000301067.7: GRCh: 37: Chr: 12: [Target cancer mutation
information]: mut start: 49444760: mut end: 49444760: mut class: Silent: mut type: SNP: ref seq: C: mut
seq: T: mut aa: p.E902E: mutation info source: CCLE: ref target(-10 +10):
GTTCCCCAGG<u>C</u>TCAGACAGGG (SEQ ID NO: 2002): mut target(-10 +10):
GTTCCCCAGG<u>T</u>TCAGACAGGG (SEQ ID NO: 2003): [Model Cell line information]: cell: NCIH2126:
cancer type: LUNG: PAM dist: 5: indel length: 0: CRISPR gRNA ID: GF-CCELg9-452: [crRNA sequence]:
crRNA sequence: AAGGGAGATAAGGAT<u>GC</u>CCCAGG (SEQ ID NO: 2014):
SpgRNA: attctaatacgactcactataggAAGGGAGATAAGGATGCCCCgttttagagctagaaatagcaagttaaaataaggctagtccgt
tatcaacttgaaaaagtggcaccgagtcggtgc (SEQ ID NO: 2015): [Target gene information]: Gene ID: 8085: Symbol:
KMT2D: Ensembl Transcript ID: EN5T00000301067.7: GRCh: 37: Chr: 12: [Target cancer mutation
information]: mut start: 49444801: mut end: 49444803: mut class: In Frame Del: mut type: DEL: ref seq:
GTT: mut seq: -: mut aa: p.888_889EP+22A: mutation info source: CCLE: ref target(-10 +10):
GATAAGGATG<u>GTT</u>CCCCAGGGGG (SEQ ID NO: 2016): mut target(-10 +10): GATAAGGATG<u>---</u>
CCCCAGGGGG (SEQ ID NO: 2017): [Model Cell line information]: cell: NCIH1650: cancer type: LUNG:
PAM dist: 5: indel length: 3: CRISPR gRNA ID: GF-CCELg9-453: [crRNA sequence]: crRNA sequence:
GATAAGGAT<u>GC</u>CCCAGGGGAGG (SEQ ID NO: 2018):
SpgRNA: attctaatacgactcactataggGATAAGGATGCCCCAGGGGgttttagagctagaaatagcaagttaaaataaggctagtccgt
tatcaacttgaaaaagtggcaccgagtcggtgc (SEQ ID NO: 2019): [Target gene information]: Gene ID: 8085: Symbol:
KMT2D: Ensembl Transcript ID: EN5T00000301067.7: GRCh: 37: Chr: 12: [Target cancer mutation
information]: mut start: 49444801: mut end: 49444803: mut class: In Frame Del: mut type: DEL: ref seq:
GTT: mut seq: -: mut aa: p.888_889EP+22A: mutation info source: CCLE: ref target(-10 +10):
GATAAGGATG<u>GTT</u>CCCCAGGGGG (SEQ ID NO: 2016): mut target(-10 +10): GATAAGGATG<u>---</u>
CCCCAGGGGG (SEQ ID NO: 2017): [Model Cell line information]: cell: NCIH1650: cancer type: LUNG:
PAM dist: 11: indel length: 3: CRISPR gRNA ID: GF-CCELg9-454: [crRNA sequence]: crRNA sequence:
T<u>GC</u>CCCAGGGGGAGGGAACAAGG (SEQ ID NO: 2020):
SpgRNA: attctaatacgactcactataggTGCCCCAGGGGGAGGGAACAgthiagagctagaaatagcaagttaaaataaggctagtccgt
tatcaacttgaaaaagtggcaccgagtcggtgc (SEQ ID NO: 2021): [Target gene information]: Gene ID: 8085: Symbol:
KMT2D: Ensembl Transcript ID: ENST00000301067.7: GRCh: 37: Chr: 12: [Target cancer mutation
information]: mut start: 49444801: mut end: 49444803: mut class: In Frame Del: mut type: DEL: ref seq:
GTT: mut seq: -: mut aa: p.888_889EP+22A: mutation info source: CCLE: ref target(-10 +10):
GATAAGGATG<u>GTT</u>CCCCAGGGGG (SEQ ID NO: 2016): mut target(-10 +10): GATAAGGATG<u>---</u>
CCCCAGGGGG (SEQ ID NO: 2017): [Model Cell line information]: cell: NCIH1650: cancer type: LUNG:
PAM dist: 19: indel length: 3: CRISPR gRNA ID: GF-CCELg9-455: [crRNA sequence]: crRNA sequence:
AGGGAGATAAGGAT<u>GC</u>CCCAGG (SEQ ID NO: 2022):
SpgRNA: attctaatacgactcactataggAGGGAGATAAGGATGCCCCAgthiagagctagaaatagcaagttaaaataaggctagtccgt
tatcaacttgaaaaagtggcaccgagtcggtgc (SEQ ID NO: 2023): [Target gene information]: Gene ID: 8085: Symbol:
KMT2D: Ensembl Transcript ID: EN5T00000301067.7: GRCh: 37: Chr: 12: [Target cancer mutation
information]: mut start: 49444801: mut end: 49444803: mut class: In Frame Del: mut type: DEL: ref seq:
GTT: mut seq: -: mut aa: p.888_889EP+22A: mutation info source: CCLE: ref target(-10 +10):
GATAAGGATGGTTCCCCAGGGGG (SEQ ID NO: 2016): mut target(-10 +10): GATAAGGATG<u>---</u>
CCCCAGGGGG (SEQ ID NO: 2017): [Model Cell line information]: cell: NCIH1650: cancer type: LUNG:
PAM dist: 6: indel length: 3: CRISPR gRNA ID: GF-CCELg9-456: [crRNA sequence]: crRNA sequence:
GGGAGATAAGGAT<u>GC</u>CCCAGGGG (SEQ ID NO: 2024):
SpgRNA: attctaatacgactcactataggGGGAGATAAGGATGCCCCAGghnagagctagaaatagcaagttaaaataaggctagtccgg
tatcaacttgaaaaagtggcaccgagtcggtgc (SEQ ID NO: 2025): [Target gene information]: Gene ID: 8085: Symbol:
KMT2D: Ensembl Transcript ID: EN5T00000301067.7: GRCh: 37: Chr: 12: [Target cancer mutation
information]: mut start: 49444801: mut end: 49444803: mut class: In Frame Del: mut type: DEL: ref seq:
GTT: mut seq: -: mut aa: p.888_889EP+22A: mutation info source: CCLE: ref target(-10 +10):
GATAAGGATG<u>GTT</u>CCCCAGGGGG (SEQ ID NO: 2016): mut target(-10 +10): GATAAGGATG<u>---</u>
CCCCAGGGGG (SEQ ID NO: 2017): [Model Cell line information]: cell: NCIH1650: cancer type: LUNG:
PAM dist: 7: indel length: 3: CRISPR gRNA ID: GF-CCELg9-457: [crRNA sequence]: crRNA sequence:
GGAGATAAGGAT<u>GC</u>CCCAGGGGG (SEQ ID NO: 2026):
SpgRNA: attctaatacgactcactataggGGAGATAAGGATGCCCCAGGghnagagctagaaatagcaagttaaaataaggctagtccgt
tatcaacttgaaaaagtggcaccgagtcggtgc (SEQ ID NO: 2027): [Target gene information]: Gene ID: 8085: Symbol:
KMT2D: Ensembl Transcript ID: EN5T00000301067.7: GRCh: 37: Chr: 12: [Target cancer mutation
information]: mut start: 49444801: mut end: 49444803: mut class: In Frame Del: mut type: DEL: ref seq:
GTT: mut seq: -: mut aa: p.888_889EP+22A: mutation info source: CCLE: ref target(-10 +10):
GATAAGGATG<u>GTT</u>CCCCAGGGGG (SEQ ID NO: 2016): mut target(-10 +10): GATAAGGATG<u>---</u>
CCCCAGGGGG (SEQ ID NO: 2017): [Model Cell line information]: cell: NCIH1650: cancer type: LUNG:
PAM dist: 8: indel length: 3: CRISPR gRNA ID: GF-CCELg9-458: [crRNA sequence]: crRNA sequence:
ATAAGGAT<u>GC</u>CCCAGGGGGAGG (SEQ ID NO: 2028):
SpgRNA: attctaatacgactcactataggATAAGGATGCCCCAGGGGAgttttagagctagaaatagcaagttaaaataaggctagtccgt
tatcaacttgaaaaagtggcaccgagtcggtgc (SEQ ID NO: 2029): [Target gene information]: Gene ID: 8085: Symbol:
KMT2D: Ensembl Transcript ID: ENST00000301067.7: GRCh: 37: Chr: 12: [Target cancer mutation
information]: mut start: 49444801: mut end: 49444803: mut class: In Frame Del: mut type: DEL: ref seq:
GTT: mut seq: -: mut aa: p.888_889EP+22A: mutation info source: CCLE: ref target(-10 +10):
GATAAGGATG<u>GTT</u>CCCCAGGGGG (SEQ ID NO: 2016): mut target(-10 +10): GATAAGGATG<u>---</u>
CCCCAGGGGG (SEQ ID NO: 2017): [Model Cell line information]: cell: NCIH1650: cancer type: LUNG:
PAM dist: 12: indel length: 3: CRISPR gRNA ID: GF-CCELg9-459: [crRNA sequence]: crRNA sequence:
<u>GC</u>CCCAGGGGGAGGGAACAAGGG (SEQ ID NO: 2030):
SpgRNA: attctaatacgactcactataggGCCCCAGGGGGAGGGAACAAgttttagagctagaaatagcaagttaaaataaggctagtccg
ttatcaacttgaaaaagtggcaccgagtcggtgc (SEQ ID NO: 2031): [Target gene information]: Gene ID: 8085:
Symbol: KMT2D: Ensembl Transcript ID: EN5T00000301067.7: GRCh: 37: Chr: 12: [Target cancer
mutation information]: mut start: 49444801: mut end: 49444803: mut class: In Frame Del: mut type: DEL:
ref seq: GTT: mut seq: -: mut aa: p.888_889EP+22A: mutation info source: CCLE: ref target(-10 +10):
GATAAGGATG<u>GTT</u>CCCCAGGGGG (SEQ ID NO: 2016): mut target(-10 +10): GATAAGGATG<u>---</u>

TABLE 7-continued

Illustrative guide RNA sequences for polypeptides comprising Cas9

CCCCAGGGGG (SEQ ID NO: 2017): [Model Cell line information]: cell: NCIH1650: cancer type: LUNG:
PAM dist: 20: indel length: 3: CRISPR gRNA ID: GF-CCELg9-460: [crRNA sequence]: crRNA sequence:
GCATCCTTATCTCCCTTGCTTGG (SEQ ID NO: 2032):
SpgRNA: attctaatacgactcactataggGCATCCTTATCTCCCTTGCTgttttagagctagaaatagcaagttaaaataaggctagtccgtta
tcaacttgaaaaagtggcaccgagtcggtgc (SEQ ID NO: 2033): [Target gene information]: Gene ID: 8085: Symbol:
KMT2D: Ensembl Transcript ID: EN5T00000301067.7: GRCh: 37: Chr: 12: [Target cancer mutation
information]: mut start: 49444801: mut end: 49444803: mut class: In Frame Del: mut type: DEL: ref seq:
GTT: mut seq: -: mut aa: p.888_889EP+22A: mutation info source: CCLE: ref target(-10 +10):
GATAAGGATGGTTCCCCAGGGGG (SEQ ID NO: 2016): mut target(-10 +10): GATAAGGATG---
CCCCAGGGGG (SEQ ID NO: 2017): [Model Cell line information]: cell: NCIH1650: cancer type: LUNG:
PAM dist: 20: indel length: 3: CRISPR gRNA ID: GF-CCELg9-461: [crRNA sequence]: crRNA sequence:
GTAGTTGGAGCTAGTGGCGTAGG (SEQ ID NO: 2034):
SpgRNA: attctaatacgactcactataggGTAGTTGGAGCTAGTGGCGTgttttagagctagaaatagcaagttaaaataaggctagtccgtt
atcaacttgaaaaagtggcaccgagtcggtgc (SEQ ID NO: 203 5): [Target gene information]: Gene ID: 3845: Symbol:
KRAS: Ensembl Transcript ID: EN5T00000256078.4: GRCh: 37: Chr: 12: [Target cancer mutation
information]: mut start: 25398285: mut end: 25398285: mut class: Missense Mutation: mut type: SNP: ref
seq: C: mut seq: T: mut aa: p.G125: mutation info source: CCLE: ref target(-10 +10):
CCTACGCCACCAGCTCCAACT (SEQ ID NO: 2036): mut target(-10 +10):
CCTACGCCACTAGCTCCAACT (SEQ ID NO: 2037): [Model Cell line information]: cell: A549: cancer
type: LUNG: PAM dist: 8: indel length: 0: CRISPR gRNA ID: GF-CCELg9-462: [crRNA sequence]: crRNA
sequence: CTTGTGGTAGTTGGAGCTAGTGG (SEQ ID NO: 2038):
SpgRNA: attctaatacgactcactataggCTTGTGGTAGTTGGAGCTAGgttttagagctagaaatagcaagttaaaataaggctagtccgtt
atcaacttgaaaaagtggcaccgagtcggtgc (SEQ ID NO: 203 9): [Target gene information]: Gene ID: 3845: Symbol:
KRAS: Ensembl Transcript ID: EN5T00000256078.4: GRCh: 37: Chr: 12: [Target cancer mutation
information]: mut start: 25398285: mut end: 25398285: mut class: Missense Mutation: mut type: SNP: ref
seq: C: mut seq: T: mut aa: p.G125: mutation info source: CCLE: ref target(-10 +10):
CCTACGCCACCAGCTCCAACT (SEQ ID NO: 2036): mut target(-10 +10):
CCTACGCCACTAGCTCCAACT (SEQ ID NO: 2037): [Model Cell line information]: cell: A549: cancer
type: LUNG: PAM dist: 2: indel length: 0: CRISPR gRNA ID: GF-CCELg9-463: [crRNA sequence]: crRNA
sequence: TCTCGACACAGCAGGTCATGAGG (SEQ ID NO: 2040):
SpgRNA: attctaatacgactcactataggTCTCGACACAGCAGGTCATGgttttagagctagaaatagcaagttaaaataaggctagtccgtt
atcaacttgaaaaagtggcaccgagtcggtgc (SEQ ID NO: 2041): [Target gene information]: Gene ID: 3845: Symbol:
KRAS: Ensembl Transcript ID: EN5T00000256078.4: GRCh: 37: Chr: 12: [Target cancer mutation
information]: mut start: 25380275: mut end: 25380275: mut class: Missense Mutation: mut type: SNP: ref
seq: T: mut seq: A: mut aa: p.Q61H: mutation info source: CCLE: ref target(-10 +10):
TGTACTCCTCTTGACCTGCTG (SEQ ID NO: 2042): mut target(-10 +10):
TGTACTCCTCATGACCTGCTG (SEQ ID NO: 2043): [Model Cell line information]: cell: NCIH460:
cancer type: LUNG: PAM dist: 2: indel length: 0: CRISPR gRNA ID: GF-CCELg9-464: [crRNA sequence]:
crRNA sequence: ATGAGGAGTACAGTGCAATGAGG (SEQ ID NO: 2044):
SpgRNA: attctaatacgactcactataggATGAGGAGTACAGTGCAATGAGgttttagagctagaaatagcaagttaaaataaggctagtccgt
tatcaacttgaaaaagtggcaccgagtcggtgc (SEQ ID NO: 2045): [Target gene information]: Gene ID: 3845: Symbol:
KRAS: Ensembl Transcript ID: EN5T00000256078.4: GRCh: 37: Chr: 12: [Target cancer mutation
information]: mut start: 25380275: mut end: 25380275: mut class: Missense Mutation: mut type: SNP: ref
seq: T: mut seq: A: mut aa: p.Q61H: mutation info source: CCLE: ref target(-10 +10):
TGTACTCCTCTTGACCTGCTG (SEQ ID NO: 2042): mut target(-10 +10):
TGTACTCCTCATGACCTGCTG (SEQ ID NO: 2043): [Model Cell line information]: cell: NCIH460:
cancer type: LUNG: PAM dist: 19: indel length: 0: CRISPR gRNA ID: GF-CCELg9-465: [crRNA sequence]:
crRNA sequence: TGAGGAGTACAGTGCAATGAGGG (SEQ ID NO: 2046):
SpgRNA: attctaatacgactcactataggTGAGGAGTACAGTGCAATGAgttttagagctagaaatagcaagttaaaataaggctagtccgt
tatcaacttgaaaaagtggcaccgagtcggtgc (SEQ ID NO: 2047): [Target gene information]: Gene ID: 3845: Symbol:
KRAS: Ensembl Transcript ID: ENST00000256078.4: GRCh: 37: Chr: 12: [Target cancer mutation
information]: mut start: 25380275: mut end: 25380275: mut class: Missense Mutation: mut type: SNP: ref
seq: T: mut seq: A: mut aa: p.Q61H: mutation info source: CCLE: ref target(-10 +10):
TGTACTCCTCTTGACCTGCTG (SEQ ID NO: 2042): mut target(-10 +10):
TGTACTCCTCATGACCTGCTG (SEQ ID NO: 2043): [Model Cell line information]: cell: NCIH460:
cancer type: LUNG: PAM dist: 20: indel length: 0: CRISPR gRNA ID: GF-CCELg9-466: [crRNA sequence]:
crRNA sequence: GTAGTTGGAGCTGATGGCGTAGG (SEQ ID NO: 2048):
SpgRNA: attctaatacgactcactataggGTAGTTGGAGCTGATGGCGTgttttagagctagaaatagcaagttaaaataaggctagtccgtt
atcaacttgaaaaagtggcaccgagtcggtgc (SEQ ID NO: 2049): [Target gene information]: Gene ID: 3845: Symbol:
KRAS: Ensembl Transcript ID: EN5T00000256078.4: GRCh: 37: Chr: 12: [Target cancer mutation
information]: mut start: 25398284: mut end: 25398284: mut class: Missense Mutation: mut type: SNP: ref
seq: C: mut seq: T: mut aa: p.G12D: mutation info source: CCLE: ref target(-10 +10):
GCCTACGCCACCAGCTCCAAC (SEQ ID NO: 2050): mut target(-10 +10):
GCCTACGCCATCAGCTCCAAC (SEQ ID NO: 2051): [Model Cell line information]: cell: 5W1990:
cancer type: PANCREAS: PAM dist: 7: indel length: 0: CRISPR gRNA ID: GF-CCELg9-467: [crRNA
sequence]: crRNA sequence: CTTGTGGTAGTTGGAGCTGATGG (SEQ ID NO: 2052):
SpgRNA: attctaatacgactcactataggCTTGTGGTAGTTGGAGCTGAgttttagagctagaaatagcaagttaaaataaggctagtccgtt
atcaacttgaaaaagtggcaccgagtcggtgc (SEQ ID NO: 2053): [Target gene information]: Gene ID: 3845: Symbol:
KRAS: Ensembl Transcript ID: EN5T00000256078.4: GRCh: 37: Chr: 12: [Target cancer mutation
information]: mut start: 25398284: mut end: 25398284: mut class: Missense Mutation: mut type: SNP: ref
seq: C: mut seq: T: mut aa: p.G12D: mutation info source: CCLE: ref target(-10 +10):
GCCTACGCCACCAGCTCCAAC (SEQ ID NO: 2050): mut target(-10 +10):
GCCTACGCCATCAGCTCCAAC (SEQ ID NO: 2051): [Model Cell line information]: cell: 5W1990:
cancer type: PANCREAS: PAM dist: 1: indel length: 0: CRISPR gRNA ID: GF-CCELg9-468: [crRNA
sequence]: crRNA sequence: TTGGCTGATGTTTCAATAAAAGG (SEQ ID NO: 2054):
SpgRNA: attctaatacgactcactataggTTGGCTGATGTTTCAATAAgttttagagctagaaatagcaagttaaaataaggctagtccgtt
atcaacttgaaaaagtggcaccgagtcggtgc (SEQ ID NO: 2055): [Target gene information]: Gene ID: 3845: Symbol:
KRAS: Ensembl Transcript ID: EN5T00000256078.4: GRCh: 37: Chr: 12: [Target cancer mutation TABLE 7-continued Illustrative guide RNA sequences for polypeptides comprising Cas9 information]: mut start: 25378560: mut end: 25378560: mut class: Silent: mut type: SNP: ref seq: T: mut
seq: G: mut aa: p.A146A: mutation info source: CCLE: ref target(-10 +10): GTCTTGTCTTTGCTGATGTTT
(SEQ ID NO: 567): mut target(-10 +10): GTCTTGTCTTGGCTGATGTTT (SEQ ID NO: 568): [Model
Cell line information]: cell: CFPAC1: cancer type: PANCREAS: PAM dist: 18: indel length: 0: CRISPR
gRNA ID: GF-CCELg9-469: [crRNA sequence]: crRNA sequence: GTTACTTACCTGTCTTGTCTTGG
(SEQ ID NO: 2056):
SpgRNA: attctaatacgactcactataggGTTACTTACCTGTCTTGTCTgttttagagctagaaatagcaagttaaaataaggctagtccgttat
caacttgaaaaagtggcaccgagtcggtgc (SEQ ID NO: 2057): [Target gene information]: Gene ID: 3845: Symbol:
KRAS: Ensembl Transcript ID: ENST00000256078.4: GRCh: 37: Chr: 12: [Target cancer mutation
information]: mut start: 25378560: mut end: 25378560: mut class: Silent: mut type: SNP: ref seq: T: mut
seq: G: mut aa: p.A146A: mutation info source: CCLE: ref target(-10 +10): GTCTTGTCTTTGCTGATGTTT
(SEQ ID NO: 567): mut target(-10 +10): GTCTTGTCTTGGCTGATGTTT (SEQ ID NO: 568): [Model
Cell line information]: cell: CFPAC1: cancer type: PANCREAS: PAM dist: -1: indel length: 0: CRISPR
gRNA ID: GF-CCELg9-470: [crRNA sequence]: crRNA sequence: AACATCAGCCAAGACAAGACAGG
(SEQ ID NO: 2058):
SpgRNA: attctaatacgactcactataggAACATCAGCCAAGACAAGACgttttagagctagaaatagcaagttaaaataaggctagtccgt
tatcaacttgaaaaagtggcaccgagtcggtgc (SEQ ID NO: 2059): [Target gene information]: Gene ID: 3845: Symbol:
KRAS: Ensembl Transcript ID: EN5T00000256078.4: GRCh: 37: Chr: 12: [Target cancer mutation
information]: mut start: 25378560: mut end: 25378560: mut class: Silent: mut type: SNP: ref seq: T: mut
seq: G: mut aa: p.A146A: mutation info source: CCLE: ref target(-10 +10): GTCTTGTCTTTGCTGATGTTT
(SEQ ID NO: 567): mut target(-10 +10): GTCTTGTCTTGGCTGATGTTT (SEQ ID NO: 568): [Model
Cell line information]: cell: CFPAC1: cancer type: PANCREAS: PAM dist: 11: indel length: 0: CRISPR
gRNA ID: GF-CCELg9-471: [crRNA sequence]: crRNA sequence: GTAGTTGGAGCTGTTGGCGTAGG
(SEQ ID NO: 2060):
SpgRNA: attctaatacgactcactataggGTAGTTGGAGCTGTTGGCGTgttttagagctagaaatagcaagttaaaataaggctagtccgtt
atcaacttgaaaaagtggcaccgagtcggtgc (SEQ ID NO: 2061): [Target gene information]: Gene ID: 3845: Symbol:
KRAS: Ensembl Transcript ID: EN5T00000256078.4: GRCh: 37: Chr: 12: [Target cancer mutation
information]: mut start: 25398284: mut end: 25398284: mut class: Missense Mutation: mut type: SNP: ref
seq: C: mut seq: A: mut aa: p.G12V: mutation info source: CCLE: ref target(-10 +10):
GCCTACGCCACCAGCTCCAAC (SEQ ID NO: 2050): mut target(-10 +10):
GCCTACGCCAAACAGCTCCAAC (SEQ ID NO: 2062): [Model Cell line information]: cell: CFPAC1:
cancer type: PANCREAS: PAM dist: 7: indel length: 0: CRISPR gRNA ID: GF-CCELg9-472: [crRNA
sequence]: crRNA sequence: CTTGTGGTAGTTGGAGCTGTTGG (SEQ ID NO: 2063):
SpgRNA: attctaatacgactcactataggCTTGTGGTAGTTGGAGCTGTgttttagagctagaaatagcaagttaaaataaggctagtccgtt
atcaacttgaaaaagtggcaccgagtcggtgc (SEQ ID NO: 2064): [Target gene information]: Gene ID: 3845: Symbol:
KRAS: Ensembl Transcript ID: EN5T00000256078.4: GRCh: 37: Chr: 12: [Target cancer mutation
information]: mut start: 25398284: mut end: 25398284: mut class: Missense Mutation: mut type: SNP: ref
seq: C: mut seq: A: mut aa: p.G12V: mutation info source: CCLE: ref target(-10 +10):
GCCTACGCCACCAGCTCCAAC (SEQ ID NO: 2050): mut target(-10 +10):
GCCTACGCCAAACAGCTCCAAC (SEQ ID NO: 2062): [Model Cell line information]: cell: CFPAC1:
cancer type: PANCREAS: PAM dist: 1: indel length: 0: CRISPR gRNA ID: GF-CCELg9-473: [crRNA
sequence]: crRNA sequence: GTAGTTGGAGCTGATGGCGTAGG (SEQ ID NO: 2048):
SpgRNA: attctaatacgactcactataggGTAGTTGGAGCTGATGGCGTgttttagagctagaaatagcaagttaaaataaggctagtccgtt
atcaacttgaaaaagtggcaccgagtcggtgc (SEQ ID NO: 2049): [Target gene information]: Gene ID: 3845: Symbol:
KRAS: Ensembl Transcript ID: EN5T00000256078.4: GRCh: 37: Chr: 12: [Target cancer mutation
information]: mut start: 25398284: mut end: 25398284: mut class: Missense Mutation: mut type: SNP: ref
seq: C: mut seq: T: mut aa: p.G12D: mutation info source: CCLE: ref target(-10 +10):
GCCTACGCCACCAGCTCCAAC (SEQ ID NO: 2050): mut target(-10 +10):
GCCTACGCCATCAGCTCCAAC (SEQ ID NO: 2051): [Model Cell line information]: cell: HPAFII:
cancer type: PANCREAS: PAM dist: 7: indel length: 0: CRISPR gRNA ID: GF-CCELg9-474: [crRNA
sequence]: crRNA sequence: CTTGTGGTAGTTGGAGCTGATGG (SEQ ID NO: 2052):
SpgRNA: attctaatacgactcactataggCTTGTGGTAGTTGGAGCTGAgttttagagctagaaatagcaagttaaaataaggctagtccgtt
atcaacttgaaaaagtggcaccgagtcggtgc (SEQ ID NO: 2053): [Target gene information]: Gene ID: 3845: Symbol:
KRAS: Ensembl Transcript ID: EN5T00000256078.4: GRCh: 37: Chr: 12: [Target cancer mutation
information]: mut start: 25398284: mut end: 25398284: mut class: Missense Mutation: mut type: SNP: ref
seq: C: mut seq: T: mut aa: p.G12D: mutation info source: CCLE: ref target(-10 +10):
GCCTACGCCACCAGCTCCAAC (SEQ ID NO: 2050): mut target(-10 +10):
GCCTACGCCATCAGCTCCAAC (SEQ ID NO: 2051): [Model Cell line information]: cell: HPAFII:
cancer type: PANCREAS: PAM dist: 1: indel length: 0: CRISPR gRNA ID: GF-CCELg9-475: [crRNA
sequence]: crRNA sequence: GTAGTTGGAGCTGCTGGCGTAGG (SEQ ID NO: 2065):
SpgRNA: attctaatacgactcactataggGTAGTTGGAGCTGCTGGCGTgttttagagctagaaatagcaagttaaaataaggctagtccgtt
atcaacttgaaaaagtggcaccgagtcggtgc (SEQ ID NO: 2066): [Target gene information]: Gene ID: 3845: Symbol:
KRAS: Ensembl Transcript ID: EN5T00000256078.4: GRCh: 37: Chr: 12: [Target cancer mutation
information]: mut start: 25398284: mut end: 25398284: mut class: Missense Mutation: mut type: SNP: ref
seq: C: mut seq: G: mut aa: p.G12A: mutation info source: CCLE: ref target(-10 +10):
GCCTACGCCACCAGCTCCAAC (SEQ ID NO: 2050): mut target(-10 +10):
GCCTACGCCAGCAGCTCCAAC (SEQ ID NO: 2067): [Model Cell line information]: cell: NCIH1573:
cancer type: LUNG: PAM dist: 7: indel length: 0: CRISPR gRNA ID: GF-CCELg9-476: [crRNA sequence]:
crRNA sequence: CTTGTGGTAGTTGGAGCTGCTGG (SEQ ID NO: 2068):
SpgRNA: attctaatacgactcactataggCTTGTGGTAGTTGGAGCTGCgttttagagctagaaatagcaagttaaaataaggctagtccgtt
atcaacttgaaaaagtggcaccgagtcggtgc (SEQ ID NO: 2069): [Target gene information]: Gene ID: 3845: Symbol:
KRAS: Ensembl Transcript ID: EN5T00000256078.4: GRCh: 37: Chr: 12: [Target cancer mutation
information]: mut start: 25398284: mut end: 25398284: mut class: Missense Mutation: mut type: SNP: ref
seq: C: mut seq: G: mut aa: p.G12A: mutation info source: CCLE: ref target(-10 +10):
GCCTACGCCACCAGCTCCAAC (SEQ ID NO: 2050): mut target(-10 +10):
GCCTACGCCAGCAGCTCCAAC (SEQ ID NO: 2067): [Model Cell line information]: cell: NCIH1573:
cancer type: LUNG: PAM dist: 1: indel length: 0: CRISPR gRNA ID: GF-CCELg9-477: [crRNA sequence]:
crRNA sequence: AGTGTCACTGTTTGGTTCTGCGG (SEQ ID NO: 2070):

TABLE 7-continued

Illustrative guide RNA sequences for polypeptides comprising Cas9

SpgRNA: attctaatacgactcactataggAGTGTCACTGTTTGGTTCTGgttttagagctagaaatagcaagttaaaataaggctagtccgtta
tcaacttgaaaaagtggcaccgagtcggtgc (SEQ ID NO: 2071): [Target gene information]: Gene ID: 26524: Symbol:
LATS2: Ensembl Transcript ID: EN5T00000382592.4: GRCh: 37: Chr: 13: [Target cancer mutation
information]: mut start: 21620047: mut end: 21620047: mut class: Missense Mutation: mut type: SNP: ref
seq: C: mut seq: T: mut aa: p.G40E: mutation info source: CCLE: ref target(-10 +10):
ACTGTTTGGTCCTGCGGGTAG (SEQ ID NO: 585): mut target(-10 +10):
ACTGTTTGGTTCTGCGGGTAG (SEQ ID NO: 586): [Model Cell line information]: cell: NCIH2126:
cancer type: LUNG: PAM dist: 4: indel length: 0: CRISPR gRNA ID: GF-CCELg9-478: [crRNA sequence]:
crRNA sequence: GTGTCACTGTTTGGTTCTGCGGG (SEQ ID NO: 2072):
SpgRNA: attctaatacgactcactataggGTGTCACTGTTTGGTTCTGCgttttagagctagaaatagcaagttaaaataaggctagtccgtta
tcaacttgaaaaagtggcaccgagtcggtgc (SEQ ID NO: 2073): [Target gene information]: Gene ID: 26524: Symbol:
LATS2: Ensembl Transcript ID: EN5T00000382592.4: GRCh: 37: Chr: 13: [Target cancer mutation
information]: mut start: 21620047: mut end: 21620047: mut class: Missense Mutation: mut type: SNP: ref
seq: C: mut seq: T: mut aa: p.G40E: mutation info source: CCLE: ref target(-10 +10):
ACTGTTTGGTCCTGCGGGTAG (SEQ ID NO: 585): mut target(-10 +10):
ACTGTTTGGTTCTGCGGGTAG (SEQ ID NO: 586): [Model Cell line information]: cell: NCIH2126:
cancer type: LUNG: PAM dist: 5: indel length: 0: CRISPR gRNA ID: GF-CCELg9-479: [crRNA sequence]:
crRNA sequence: CTTTCTTACCCCGAAGCAGAAGG (SEQ ID NO: 2074):
SpgRNA: attctaatacgactcactataggCTTTCTTACCCCGAAGCAGAAGGgttttagagctagaaatagcaagttaaaataaggctagtccgtt
atcaacttgaaaaagtggcaccgagtcggtgc (SEQ ID NO: 2075): [Target gene information]: Gene ID: 5604: Symbol:
MAP2K1: Ensembl Transcript ID: EN5T00000307102.5: GRCh: 37: Chr: 15: [Target cancer mutation
information]: mut start: 66727451: mut end: 66727451: mut class: Missense Mutation: mut type: SNP: ref
seq: A: mut seq: C: mut aa: p.Q56P: mutation info source: CCLE: ref target(-10 +10):
TTTCTTACCCAGAAGCAGAAG (SEQ ID NO: 589): mut target(-10 +10):
TTTCTTACCCCGAAGCAGAAG (SEQ ID NO: 590): [Model Cell line information]: cell: NCIH1437:
cancer type: LUNG: PAM dist: 9: indel length: 0: CRISPR gRNA ID: GF-CCELg9-480: [crRNA sequence]:
crRNA sequence: TCTTACCCCGAAGCAGAAGGTGG (SEQ ID NO: 2076):
SpgRNA: attctaatacgactcactataggTCTTACCCCGAAGCAGAAGGgttttagagctagaaatagcaagttaaaataaggctagtccgtt
atcaacttgaaaaagtggcaccgagtcggtgc (SEQ ID NO: 2077): [Target gene information]: Gene ID: 5604: Symbol:
MAP2K1: Ensembl Transcript ID: EN5T00000307102.5: GRCh: 37: Chr: 15: [Target cancer mutation
information]: mut start: 66727451: mut end: 66727451: mut class: Missense Mutation: mut type: SNP: ref
seq: A: mut seq: C: mut aa: p.Q56P: mutation info source: CCLE: ref target(-10 +10):
TTTCTTACCCAGAAGCAGAAG (SEQ ID NO: 589): mut target(-10 +10):
TTTCTTACCCCGAAGCAGAAG (SEQ ID NO: 590): [Model Cell line information]: cell: NCIH1437:
cancer type: LUNG: PAM dist: 12: indel length: 0: CRISPR gRNA ID: GF-CCELg9-481: [crRNA sequence]:
crRNA sequence: CTTACCCCGAAGCAGAAGGTGGG (SEQ ID NO: 2078):
SpgRNA: attctaatacgactcactataggCTTACCCCGAAGCAGAAGGTgttttagagctagaaatagcaagttaaaataaggctagtccgtt
atcaacttgaaaaagtggcaccgagtcggtgc (SEQ ID NO: 2079): [Target gene information]: Gene ID: 5604: Symbol:
MAP2K1: Ensembl Transcript ID: EN5T00000307102.5: GRCh: 37: Chr: 15: [Target cancer mutation
information]: mut start: 66727451: mut end: 66727451: mut class: Missense Mutation: mut type: SNP: ref
seq: A: mut seq: C: mut aa: p.Q56P: mutation info source: CCLE: ref target(-10 +10):
TTTCTTACCCAGAAGCAGAAG (SEQ ID NO: 589): mut target(-10 +10):
TTTCTTACCCCGAAGCAGAAG (SEQ ID NO: 590): [Model Cell line information]: cell: NCIH1437:
cancer type: LUNG: PAM dist: 13: indel length: 0: CRISPR gRNA ID: GF-CCELg9-482: [crRNA sequence]:
crRNA sequence: CTTCTGCTTCGGGGTAAGAAAGG (SEQ ID NO: 2080):
SpgRNA: attctaatacgactcactataggCTTCTGCTTCGGGGTAAGAAgttttagagctagaaatagcaagttaaaataaggctagtccgtt
atcaacttgaaaaagtggcaccgagtcggtgc (SEQ ID NO: 2081): [Target gene information]: Gene ID: 5604: Symbol:
MAP2K1: Ensembl Transcript ID: EN5T00000307102.5: GRCh: 37: Chr: 15: [Target cancer mutation
information]: mut start: 66727451: mut end: 66727451: mut class: Missense Mutation: mut type: SNP: ref
seq: A: mut seq: C: mut aa: p.Q56P: mutation info source: CCLE: ref target(-10 +10):
TTTCTTACCCAGAAGCAGAAG (SEQ ID NO: 589): mut target(-10 +10):
TTTCTTACCCCGAAGCAGAAG (SEQ ID NO: 590): [Model Cell line information]: cell: NCIH1437:
cancer type: LUNG: PAM dist: 10: indel length: 0: CRISPR gRNA ID: GF-CCELg9-483: [crRNA sequence]:
crRNA sequence: TCGGGGTAAGAAAGGCCTCAAGG (SEQ ID NO: 2082):
SpgRNA: attctaatacgactcactataggTCGGGGTAAGAAAGGCCTCAgttttagagctagaaatagcaagttaaaataaggctagtccgt
tatcaacttgaaaaagtggcaccgagtcggtgc (SEQ ID NO: 2083): [Target gene information]: Gene ID: 5604: Symbol:
MAP2K1: Ensembl Transcript ID: ENST00000307102.5: GRCh: 37: Chr: 15: [Target cancer mutation
information]: mut start: 66727451: mut end: 66727451: mut class: Missense Mutation: mut type: SNP: ref
seq: A: mut seq: C: mut aa: p.Q56P: mutation info source: CCLE: ref target(-10 +10):
TTTCTTACCCAGAAGCAGAAG (SEQ ID NO: 589): mut target(-10 +10):
TTTCTTACCCCGAAGCAGAAG (SEQ ID NO: 590): [Model Cell line information]: cell: NCIH1437:
cancer type: LUNG: PAM dist: 18: indel length: 0: CRISPR gRNA ID: GF-CCELg9-484: [crRNA sequence]:
crRNA sequence: AGTTCTCCCACCTTCTGCTTCGG (SEQ ID NO: 2084):
SpgRNA: attctaatacgactcactataggAGTTCTCCCACCTTCTGCTTgttttagagctagaaatagcaagttaaaataaggctagtccgtta
tcaacttgaaaaagtggcaccgagtcggtgc (SEQ ID NO: 2085): [Target gene information]: Gene ID: 5604: Symbol:
MAP2K1: Ensembl Transcript ID: EN5T00000307102.5: GRCh: 37: Chr: 15: [Target cancer mutation
information]: mut start: 66727451: mut end: 66727451: mut class: Missense Mutation: mut type: SNP: ref
seq: A: mut seq: C: mut aa: p.Q56P: mutation info source: CCLE: ref target(-10 +10):
TTTCTTACCCAGAAGCAGAAG (SEQ ID NO: 589): mut target(-10 +10):
TTTCTTACCCCGAAGCAGAAG (SEQ ID NO: 590): [Model Cell line information]: cell: NCIH1437:
cancer type: LUNG: PAM dist: -1: indel length: 0: CRISPR gRNA ID: GF-CCELg9-485: [crRNA sequence]:
crRNA sequence: GTTCTCCCACCTTCTGCTTCGGG (SEQ ID NO: 2086):
SpgRNA: attctaatacgactcactataggGTTCTCCCACCTTCTGCTTCGgttttagagctagaaatagcaagttaaaataaggctagtccgttat
caacttgaaaaagtggcaccgagtcggtgc (SEQ ID NO: 2087): [Target gene information]: Gene ID: 5604: Symbol:
MAP2K1: Ensembl Transcript ID: EN5T00000307102.5: GRCh: 37: Chr: 15: [Target cancer mutation
information]: mut start: 66727451: mut end: 66727451: mut class: Missense Mutation: mut type: SNP: ref
seq: A: mut seq: C: mut aa: p.Q56P: mutation info source: CCLE: ref target(-10 +10):
TTTCTTACCCAGAAGCAGAAG (SEQ ID NO: 589): mut target(-10 +10):

TABLE 7-continued

Illustrative guide RNA sequences for polypeptides comprising Cas9

TTTCTTACCCCGAAGCAGAAG (SEQ ID NO: 590): [Model Cell line information]: cell: NCIH1437:
cancer type: LUNG: PAM dist: 0: indel length: 0: CRISPR gRNA ID: GF-CCELg9-486: [crRNA sequence]:
crRNA sequence: TTCTCCCACCTTCTGCTTCGGGG (SEQ ID NO: 2088):
SpgRNA: attctaatacgactcactataggTTCTCCCACCTTCTGCTTCGgttttagagctagaaatagcaagttaaaataaggctagtccgttat
caacttgaaaaagtggcaccgagtcggtgc (SEQ ID NO: 2089): [Target gene information]: Gene ID: 5604: Symbol:
MAP2K1: Ensembl Transcript ID: EN5T00000307102.5: GRCh: 37: Chr: 15: [Target cancer mutation
information]: mut start: 66727451: mut end: 66727451: mut class: Missense Mutation: mut type: SNP: ref
seq: A: mut seq: C: mut aa: p.Q56P: mutation info source: CCLE: ref target(-10 +10):
TTTCTTACCCAGAAGCAGAAG (SEQ ID NO: 589): mut target(-10 +10):
TTTCTTACCCCGAAGCAGAAG (SEQ ID NO: 590): [Model Cell line information]: cell: NCIH1437:
cancer type: LUNG: PAM dist: 1: indel length: 0: CRISPR gRNA ID: GF-CCELg9-487: [crRNA sequence]:
crRNA sequence: TATGGTGCGTTCTGCAGCGATGG (SEQ ID NO: 2090):
SpgRNA: attctaatacgactcactataggTATGGTGCGTTCTGCAGCGAgttttagagctagaaatagcaagttaaaataaggctagtccgtt
atcaacttgaaaaagtggcaccgagtcggtgc (SEQ ID NO: 2091): [Target gene information]: Gene ID: 5604: Symbol:
MAP2K1: Ensembl Transcript ID: EN5T00000307102.5: GRCh: 37: Chr: 15: [Target cancer mutation
information]: mut start: 66729193: mut end: 66729193: mut class: Missense Mutation: mut type: SNP: ref
seq: A: mut seq: G: mut aa: p.Y134C: mutation info source: CCLE: ref target(-10 +10):
GGTGCGTTCTACAGCGATGGC (SEQ ID NO: 2092): mut target(-10 +10):
GGTGCGTTCTGCAGCGATGGC (SEQ ID NO: 2093): [Model Cell line information]: cell: NCIH460:
cancer type: LUNG: PAM dist: 7: indel length: 0: CRISPR gRNA ID: GF-CCELg9-488: [crRNA sequence]:
crRNA sequence: GCTCCGAGCCCGAGCGGCAGCGG (SEQ ID NO: 2094):
SpgRNA: attctaatacgactcactataggGCTCCGAGCCCGAGCGGCAGgttttagagctagaaatagcaagttaaaataaggctagtccgt
tatcaacttgaaaaagtggcaccgagtcggtgc (SEQ ID NO: 2095): [Target gene information]: Gene ID: 6416: Symbol:
MAP2K4: Ensembl Transcript ID: EN5T00000353533.5: GRCh: 37: Chr: 17: [Target cancer mutation
information]: mut start: 11924228: mut end: 11924228: mut class: Missense Mutation: mut type: SNP: ref
seq: G: mut seq: A: mut aa: p.G9S: mutation info source: CCLE: ref target(-10 +10):
CCCGAGCGGCGGCGGCGGCTC (SEQ ID NO: 2096): mut target(-10 +10):
CCCGAGCGGCAGCGGCGGCTC (SEQ ID NO: 2097): [Model Cell line information]: cell: NCIH1563:
cancer type: LUNG: PAM dist: 2: indel length: 0: CRISPR gRNA ID: GF-CCELg9-489: [crRNA sequence]:
crRNA sequence: CCGAGCCCGAGCGGCAGCGGCGG (SEQ ID NO: 2098):
SpgRNA: attctaatacgactcactataggCCGAGCCCGAGCGGCAGCGGCGGgttttagagctagaaatagcaagttaaaataaggctagtccgt
tatcaacttgaaaaagtggcaccgagtcggtgc (SEQ ID NO: 2099): [Target gene information]: Gene ID: 6416: Symbol:
MAP2K4: Ensembl Transcript ID: EN5T00000353533.5: GRCh: 37: Chr: 17: [Target cancer mutation
information]: mut start: 11924228: mut end: 11924228: mut class: Missense Mutation: mut type: SNP: ref
seq: G: mut seq: A: mut aa: p.G9S: mutation info source: CCLE: ref target(-10 +10):
CCCGAGCGGCGGCGGCGGCTC (SEQ ID NO: 2096): mut target(-10 +10):
CCCGAGCGGCAGCGGCGGCTC (SEQ ID NO: 2097): [Model Cell line information]: cell: NCIH1563:
cancer type: LUNG: PAM dist: 5: indel length: 0: CRISPR gRNA ID: GF-CCELg9-490: [crRNA sequence]:
crRNA sequence: CCGAGCGGCAGCGGCGGCTCCGG (SEQ ID NO: 2100):
SpgRNA: attctaatacgactcactataggCCGAGCGGCAGCGGCGGCTCgttttagagctagaaatagcaagttaaaataaggctagtccgt
tatcaacttgaaaaagtggcaccgagtcggtgc (SEQ ID NO: 2101): [Target gene information]: Gene ID: 6416: Symbol:
MAP2K4: Ensembl Transcript ID: EN5T00000353533.5: GRCh: 37: Chr: 17: [Target cancer mutation
information]: mut start: 11924228: mut end: 11924228: mut class: Missense Mutation: mut type: SNP: ref
seq: G: mut seq: A: mut aa: p.G9S: mutation info source: CCLE: ref target(-10 +10):
CCCGAGCGGCGGCGGCGGCTC (SEQ ID NO: 2096): mut target(-10 +10):
CCCGAGCGGCAGCGGCGGCTC (SEQ ID NO: 2097): [Model Cell line information]: cell: NCIH1563:
cancer type: LUNG: PAM dist: 11: indel length: 0: CRISPR gRNA ID: GF-CCELg9-491: [crRNA sequence]:
crRNA sequence: GGCAGCGGCGGCTCCGGGGGCGG (SEQ ID NO: 2102):
SpgRNA: attctaatacgactcactataggGGCAGCGGCGGCTCCGGGGGgttttagagctagaaatagcaagttaaaataaggctagtccgt
tatcaacttgaaaaagtggcaccgagtcggtgc (SEQ ID NO: 2103): [Target gene information]: Gene ID: 6416: Symbol:
MAP2K4: Ensembl Transcript ID: ENST00000353533.5: GRCh: 37: Chr: 17: [Target cancer mutation
information]: mut start: 11924228: mut end: 11924228: mut class: Missense Mutation: mut type: SNP: ref
seq: G: mut seq: A: mut aa: p.G9S: mutation info source: CCLE: ref target(-10 +10):
CCCGAGCGGCGGCGGCGGCTC (SEQ ID NO: 2096): mut target(-10 +10):
CCCGAGCGGCAGCGGCGGCTC (SEQ ID NO: 2097): [Model Cell line information]: cell: NCIH1563:
cancer type: LUNG: PAM dist: 17: indel length: 0: CRISPR gRNA ID: GF-CCELg9-492: [crRNA sequence]:
crRNA sequence: CGAGCGGCAGCGGCGGCTCCGGG (SEQ ID NO: 2104):
SpgRNA: attctaatacgactcactataggCGAGCGGCAGCGGCGGCTCCgttttagagctagaaatagcaagttaaaataaggctagtccgt
tatcaacttgaaaaagtggcaccgagtcggtgc (SEQ ID NO: 2105): [Target gene information]: Gene ID: 6416: Symbol:
MAP2K4: Ensembl Transcript ID: EN5T00000353533.5: GRCh: 37: Chr: 17: [Target cancer mutation
information]: mut start: 11924228: mut end: 11924228: mut class: Missense Mutation: mut type: SNP: ref
seq: G: mut seq: A: mut aa: p.G9S: mutation info source: CCLE: ref target(-10 +10):
CCCGAGCGGCGGCGGCGGCTC (SEQ ID NO: 2096): mut target(-10 +10):
CCCGAGCGGCAGCGGCGGCTC (SEQ ID NO: 2097): [Model Cell line information]: cell: NCIH1563:
cancer type: LUNG: PAM dist: 12: indel length: 0: CRISPR gRNA ID: GF-CCELg9-493: [crRNA sequence]:
crRNA sequence: GAGCGGCAGCGGCGGCTCCGGGG (SEQ ID NO: 2106):
SpgRNA: attctaatacgactcactataggGAGCGGCAGCGGCGGCTCCGgttttagagctagaaatagcaagttaaaataaggctagtccgt
tatcaacttgaaaaagtggcaccgagtcggtgc (SEQ ID NO: 2107): [Target gene information]: Gene ID: 6416: Symbol:
MAP2K4: Ensembl Transcript ID: EN5T00000353533.5: GRCh: 37: Chr: 17: [Target cancer mutation
information]: mut start: 11924228: mut end: 11924228: mut class: Missense Mutation: mut type: SNP: ref
seq: G: mut seq: A: mut aa: p.G9S: mutation info source: CCLE: ref target(-10 +10):
CCCGAGCGGCGGCGGCGGCTC (SEQ ID NO: 2096): mut target(-10 +10):
CCCGAGCGGCAGCGGCGGCTC (SEQ ID NO: 2097): [Model Cell line information]: cell: NCIH1563:
cancer type: LUNG: PAM dist: 13: indel length: 0: CRISPR gRNA ID: GF-CCELg9-494: [crRNA sequence]:
crRNA sequence: AGCGGCAGCGGCGGCTCCGGGGG (SEQ ID NO: 2108):
SpgRNA: attctaatacgactcactataggAGCGGCAGCGGCGGCTCCGGgttttagagctagaaatagcaagttaaaataaggctagtccgt
tatcaacttgaaaaagtggcaccgagtcggtgc (SEQ ID NO: 2109): [Target gene information]: Gene ID: 6416: Symbol:
MAP2K4: Ensembl Transcript ID: ENST00000353533.5: GRCh: 37: Chr: 17: [Target cancer mutation TABLE 7-continued Illustrative guide RNA sequences for polypeptides comprising Cas9 information]: mut start: 11924228: mut end: 11924228: mut class: Missense Mutation: mut type: SNP: ref
seq: G: mut seq: A: mut aa: p.G9S: mutation info source: CCLE: ref target(-10 +10):
CCCGAGCGGCGGCGGCGGCTC (SEQ ID NO: 2096): mut target(-10 +10):
CCCGAGCGGCAGCGGCGGCTC (SEQ ID NO: 2097): [Model Cell line information]: cell: NCIH1563:
cancer type: LUNG: PAM dist: 14: indel length: 0: CRISPR gRNA ID: GF-CCELg9-495: [crRNA sequence]:
crRNA sequence: CCGGAGCCGCCGCTGCCGCTCGG (SEQ ID NO: 2110):
SpgRNA: attctaatacgactcactataggCCGGAGCCGCCGCTGCCGCT gttttagagctagaaatagcaagttaaaataaggctagtccgtt
atcaacttgaaaaagtggcaccgagtcggtgc (SEQ ID NO: 2111): [Target gene information]: Gene ID: 6416: Symbol:
MAP2K4: Ensembl Transcript ID: EN5T00000353533.5: GRCh: 37: Chr: 17: [Target cancer mutation
information]: mut start: 11924228: mut end: 11924228: mut class: Missense Mutation: mut type: SNP: ref
seq: G: mut seq: A: mut aa: p.G95: mutation info source: CCLE: ref target(-10 +10):
CCCGAGCGGCGGCGGCGGCTC (SEQ ID NO: 2096): mut target(-10 +10):
CCCGAGCGGCAGCGGCGGCTC (SEQ ID NO: 2097): [Model Cell line information]: cell: NCIH1563:
cancer type: LUNG: PAM dist: 7: indel length: 0: CRISPR gRNA ID: GF-CCELg9-496: [crRNA sequence]:
crRNA sequence: CCGCCGCTGCCGCTCGGGCTGG (SEQ ID NO: 2112):
SpgRNA: attctaatacgactcactataggCCGCCGCTGCCGCTCGGGCT gttttagagctagaaatagcaagttaaaataaggctagtccgtt
atcaacttgaaaaagtggcaccgagtcggtgc (SEQ ID NO: 2113): [Target gene information]: Gene ID: 6416: Symbol:
MAP2K4: Ensembl Transcript ID: EN5T00000353533.5: GRCh: 37: Chr: 17: [Target cancer mutation
information]: mut start: 11924228: mut end: 11924228: mut class: Missense Mutation: mut type: SNP: ref
seq: G: mut seq: A: mut aa: p.G95: mutation info source: CCLE: ref target(-10 +10):
CCCGAGCGGCGGCGGCGGCTC (SEQ ID NO: 2096): mut target(-10 +10):
CCCGAGCGGCAGCGGCGGCTC (SEQ ID NO: 2097): [Model Cell line information]: cell: NCIH1563:
cancer type: LUNG: PAM dist: 13: indel length: 0: CRISPR gRNA ID: GF-CCELg9-497: [crRNA sequence]:
crRNA sequence: CGGAGCCGCCGCTGCCGCTCGG (SEQ ID NO: 2114):
SpgRNA: attctaatacgactcactataggCGGAGCCGCCGCTGCCGCTC gttttagagctagaaatagcaagttaaaataaggctagtccgtt
atcaacttgaaaaagtggcaccgagtcggtgc (SEQ ID NO: 2115): [Target gene information]: Gene ID: 6416: Symbol:
MAP2K4: Ensembl Transcript ID: EN5T00000353533.5: GRCh: 37: Chr: 17: [Target cancer mutation
information]: mut start: 11924228: mut end: 11924228: mut class: Missense Mutation: mut type: SNP: ref
seq: G: mut seq: A: mut aa: p.G95: mutation info source: CCLE: ref target(-10 +10):
CCCGAGCGGCGGCGGCGGCTC (SEQ ID NO: 2096): mut target(-10 +10):
CCCGAGCGGCAGCGGCGGCTC (SEQ ID NO: 2097): [Model Cell line information]: cell: NCIH1563:
cancer type: LUNG: PAM dist: 8: indel length: 0: CRISPR gRNA ID: GF-CCELg9-498: [crRNA sequence]:
crRNA sequence: CGCGAAGAAAAGCAGCCTTGCGG (SEQ ID NO: 2116):
SpgRNA: attctaatacgactcactataggCGCGAAGAAAAGCAGCCTTG gttttagagctagaaatagcaagttaaaataaggctagtccgt
tatcaacttgaaaaagtggcaccgagtcggtgc (SEQ ID NO: 2117): [Target gene information]: Gene ID: 4170: Symbol:
MCL1: Ensembl Transcript ID: ENST00000369026.2: GRCh: 37: Chr: 1: [Target cancer mutation
information]: mut start: 150551725: mut end: 150551725: mut class: Silent: mut type: SNP: ref seq: C: mut
seq: T: mut aa: p.A94A: mutation info source: CCLE: ref target(-10 +10):
AAAGCAGCCTCGCGGGGGTCG (SEQ ID NO: 2118): mut target(-10 +10):
AAAGCAGCCTTGCGGGGGTCG (SEQ ID NO: 2119): [Model Cell line information]: cell: NCIH1563:
cancer type: LUNG: PAM dist: 2: indel length: 0: CRISPR gRNA ID: GF-CCELg9-499: [crRNA sequence]:
crRNA sequence: AAGCAGCCTTGCGGGGGTCGGG (SEQ ID NO: 2120):
SpgRNA: attctaatacgactcactataggAAGCAGCCTTGCGGGGGTCG gtttagagctagaaatagcaagttaaaataaggctagtccgt
tatcaacttgaaaaagtggcaccgagtcggtgc (SEQ ID NO: 2121): [Target gene information]: Gene ID: 4170: Symbol:
MCL1: Ensembl Transcript ID: EN5T00000369026.2: GRCh: 37: Chr: 1: [Target cancer mutation
information]: mut start: 150551725: mut end: 150551725: mut class: Silent: mut type: SNP: ref seq: C: mut
seq: T: mut aa: p.A94A: mutation info source: CCLE: ref target(-10 +10):
AAAGCAGCCTCGCGGGGGTCG (SEQ ID NO: 2118): mut target(-10 +10):
AAAGCAGCCTTGCGGGGGTCG (SEQ ID NO: 2119): [Model Cell line information]: cell: NCIH1563:
cancer type: LUNG: PAM dist: 11: indel length: 0: CRISPR gRNA ID: GF-CCELg9-500: [crRNA sequence]:
crRNA sequence: TGCGGGGGTCGCGGTGACGTCGG (SEQ ID NO: 2122):
SpgRNA: attctaatacgactcactataggTGCGGGGGTCGCGGTGACGT gttttagagctagaaatagcaagttaaaataaggctagtccgtt
atcaacttgaaaaagtggcaccgagtcggtgc (SEQ ID NO: 2123): [Target gene information]: Gene ID: 4170: Symbol:
MCL1: Ensembl Transcript ID: EN5T00000369026.2: GRCh: 37: Chr: 1: [Target cancer mutation
information]: mut start: 150551725: mut end: 150551725: mut class: Silent: mut type: SNP: ref seq: C: mut
seq: T: mut aa: p.A94A: mutation info source: CCLE: ref target(-10 +10):
AAAGCAGCCTCGCGGGGGTCG (SEQ ID NO: 2118): mut target(-10 +10):
AAAGCAGCCTTGCGGGGGTCG (SEQ ID NO: 2119): [Model Cell line information]: cell: NCIH1563:
cancer type: LUNG: PAM dist: 20: indel length: 0: CRISPR gRNA ID: GF-CCELg9-501: [crRNA sequence]:
crRNA sequence: GCGAAGAAAAGCAGCCTTGCGGG (SEQ ID NO: 2124):
SpgRNA: attctaatacgactcactataggGCGAAGAAAAGCAGCCTTGCGG gttttagagctagaaatagcaagttaaaataaggctagtccgt
tatcaacttgaaaaagtggcaccgagtcggtgc (SEQ ID NO: 2125): [Target gene information]: Gene ID: 4170: Symbol:
MCL1: Ensembl Transcript ID: EN5T00000369026.2: GRCh: 37: Chr: 1: [Target cancer mutation
information]: mut start: 150551725: mut end: 150551725: mut class: Silent: mut type: SNP: ref seq: C: mut seq: T: mut aa: p.A94A: mutation info source: CCLE: ref target(-10 +10):
AAAGCAGCCTCGCGGGGGTCG (SEQ ID NO: 2118): mut target(-10 +10):
AAAGCAGCCTTGCGGGGGTCG (SEQ ID NO: 2119): [Model Cell line information]: cell: NCIH1563:
cancer type: LUNG: PAM dist: 3: indel length: 0: CRISPR gRNA ID: GF-CCELg9-502: [crRNA sequence]:
crRNA sequence: CGAAGAAAAGCAGCCTTGCGGGG (SEQ ID NO: 2126):
SpgRNA: attctaatacgactcactataggCGAAGAAAAGCAGCCTTGCGG gttttagagctagaaatagcaagttaaaataaggctagtccgt
tatcaacttgaaaaagtggcaccgagtcggtgc (SEQ ID NO: 2127): [Target gene information]: Gene ID: 4170: Symbol:
MCL1: Ensembl Transcript ID: ENST00000369026.2: GRCh: 37: Chr: 1: [Target cancer mutation
information]: mut start: 150551725: mut end: 150551725: mut class: Silent: mut type: SNP: ref seq: C: mut
seq: T: mut aa: p.A94A: mutation info source: CCLE: ref target(-10 +10):
AAAGCAGCCTCGCGGGGGTCG (SEQ ID NO: 2118): mut target(-10 +10):
AAAGCAGCCTTGCGGGGGTCG (SEQ ID NO: 2119): [Model Cell line information]: cell: NCIH1563:
cancer type: LUNG: PAM dist: 4: indel length: 0: CRISPR gRNA ID: GF-CCELg9-503: [crRNA sequence]:

TABLE 7-continued

Illustrative guide RNA sequences for polypeptides comprising Cas9 crRNA sequence: GAAGAAAAGCAGCCTTGCGGGGG (SEQ ID NO: 2128):
SpgRNA: attctaatacgactcactataggGAAGAAAAGCAGCCTTGCGGgttttagagctagaaatagcaagttaaaataaggctagtccgt
tatcaacttgaaaaagtggcaccgagtcggtgc (SEQ ID NO: 2129): [Target gene information]: Gene ID: 4170: Symbol:
MCL1: Ensembl Transcript ID: EN5T00000369026.2: GRCh: 37: Chr: 1: [Target cancer mutation
information]: mut start: 150551725: mut end: 150551725: mut class: Silent: mut type: SNP: ref seq: C: mut
seq: T: mut aa: p.A94A: mutation info source: CCLE: ref target(-10 +10):
AAAGCAGCCTC̲GCGGGGGTCG (SEQ ID NO: 2118): mut target(-10 +10):
AAAGCAGCCTT̲GCGGGGGTCG (SEQ ID NO: 2119): [Model Cell line information]: cell: NCIH1563:
cancer type: LUNG: PAM dist: 5: indel length: 0: CRISPR gRNA ID: GF-CCELg9-504: [crRNA sequence]:
crRNA sequence: ACGTCACCGCGACCCCCGCA̲AGG (SEQ ID NO: 2130):
SpgRNA: attctaatacgactcactataggACGTCACCGCGACCCCCGCAgttttagagctagaaatagcaagttaaaataaggctagtccgtt
atcaacttgaaaaagtggcaccgagtcggtgc (SEQ ID NO: 2131): [Target gene information]: Gene ID: 4170: Symbol:
MCL1: Ensembl Transcript ID: EN5T00000369026.2: GRCh: 37: Chr: 1: [Target cancer mutation
information]: mut start: 150551725: mut end: 150551725: mut class: Silent: mut type: SNP: ref seq: C: mut
seq: T: mut aa: p.A94A: mutation info source: CCLE: ref target(-10 +10):
AAAGCAGCCTC̲GCGGGGGTCG (SEQ ID NO: 2118): mut target(-10 +10):
AAAGCAGCCTT̲GCGGGGGTCG (SEQ ID NO: 2119): [Model Cell line information]: cell: NCIH1563:
cancer type: LUNG: PAM dist: 1: indel length: 0: CRISPR gRNA ID: GF-CCELg9-505: [crRNA sequence]:
crRNA sequence: CCCTATG̲TCTCGCCGGGCCGAGG (SEQ ID NO: 2132):
Sn g RNA. attctaatacgactcactatag g CCCTA TGTCTCGCCGGGC eGg attagagctaganatagcaagttaanataaggctagtccgtt
atcaacttgaaaaagtggcaccgagtcggtgc (SEQ ID NO: 2133): [Target gene information]: Gene ID: 4170: Symbol:
MCL1: Ensembl Transcript ID: EN5T00000369026.2: GRCh: 37: Chr: 1: [Target cancer mutation
information]: mut start: 150551866: mut end: 150551866: mut class: Missense Mutation: mut type: SNP: ref
seq: C: mut seq: G: mut aa: p.E47D: mutation info source: CCLE: ref target(-10 +10):
CTCCCCCTATC̲TCTCGCCGGG (SEQ ID NO: 2134): mut target(-10 +10):
CTCCCCCTATG̲TCTCGCCGGG (SEQ ID NO: 2135): [Model Cell line information]: cell: NCIH1573:
cancer type: LUNG: PAM dist: 14: indel length: 0: CRISPR gRNA ID: GF-CCELg9-506: [crRNA sequence]:
crRNA sequence: CCCCTCCCCCTATG̲TCTCGCCGG (SEQ ID NO: 2136):
SpgRNA: attctaatacgactcactataggCCCCTCCCCCTATGTCTCGCgttttagagctagaaatagcaagttaaaataaggctagtccgtta
tcaacttgaaaaagtggcaccgagtcggtgc (SEQ ID NO: 2137): [Target gene information]: Gene ID: 4170: Symbol:
MCL1: Ensembl Transcript ID: EN5T00000369026.2: GRCh: 37: Chr: 1: [Target cancer mutation
information]: mut start: 150551866: mut end: 150551866: mut class: Missense Mutation: mut type: SNP: ref
seq: C: mut seq: G: mut aa: p.E47D: mutation info source: CCLE: ref target(-10 +10):
CTCCCCCTATC̲TCTCGCCGGG (SEQ ID NO: 2134): mut target(-10 +10):
CTCCCCCTATG̲TCTCGCCGGG (SEQ ID NO: 2135): [Model Cell line information]: cell: NCIH1573:
cancer type: LUNG: PAM dist: 7: indel length: 0: CRISPR gRNA ID: GF-CCELg9-507: [crRNA sequence]:
crRNA sequence: CCCTCCCCCTATG̲TCTCGCCGGG (SEQ ID NO: 2138):
SpgRNA: attctaatacgactcactataggCCCTCCCCCTATGTCTCGCCgttttagagctagaaatagcaagttaaaataaggctagtccgtta
tcaacttgaaaaagtggcaccgagtcggtgc (SEQ ID NO: 2139): [Target gene information]: Gene ID: 4170: Symbol:
MCL1: Ensembl Transcript ID: EN5T00000369026.2: GRCh: 37: Chr: 1: [Target cancer mutation
information]: mut start: 150551866: mut end: 150551866: mut class: Missense Mutation: mut type: SNP: ref
seq: C: mut seq: G: mut aa: p.E47D: mutation info source: CCLE: ref target(-10 +10):
CTCCCCCTATC̲TCTCGCCGGG (SEQ ID NO: 2134): mut target(-10 +10):
CTCCCCCTATG̲TCTCGCCGGG (SEQ ID NO: 2135): [Model Cell line information]: cell: NCIH1573:
cancer type: LUNG: PAM dist: 8: indel length: 0: CRISPR gRNA ID: GF-CCELg9-508: [crRNA sequence]:
crRNA sequence: GCCTCGGCCCGGCGAGAC̲ATAGG (SEQ ID NO: 2140):
SpgRNA: attctaatacgactcactataggGCCTCGGCCCGGCGAGACAT gttttagagctagaaatagcaagttaaaataaggctagtccgtt
atcaacttgaaaaagtggcaccgagtcggtgc (SEQ ID NO: 214 1): [Target gene information]: Gene ID: 4170: Symbol:
MCL1: Ensembl Transcript ID: EN5T00000369026.2: GRCh: 37: Chr: 1: [Target cancer mutation
information]: mut start: 150551866: mut end: 150551866: mut class: Missense Mutation: mut type: SNP: ref
seq: C: mut seq: G: mut aa: p.E47D: mutation info source: CCLE: ref target(-10 +10):
CTCCCCCTATC̲TCTCGCCGGG (SEQ ID NO: 2134): mut target(-10 +10):
CTCCCCCTATG̲TCTCGCCGGG (SEO ID NO: 2135'): [Model Cell line information]: cell: NCIH1573:
cancer type: LUNG: PAM dist: 3: indel length: 0: CRISPR gRNA ID: GF-CCELg9-509: [crRNA sequence]:
crRNA sequence: GCCCGGCGAGAC̲ATAGGGGGAGG (SEQ ID NO: 2142):
SpgRNA: attctaatacgactcactataggGCCCGGCGAGACATAGGGGgttttagagctagaaatagcaagttaaaataaggctagtccgt
tatcaacttgaaaaagtggcaccgagtcggtgc (SEQ ID NO: 2143): [Target gene information]: Gene ID: 4170: Symbol:
MCL1: Ensembl Transcript ID: ENST00000369026.2: GRCh: 37: Chr: 1: [Target cancer mutation
information]: mut start: 150551866: mut end: 150551866: mut class: Missense Mutation: mut type: SNP: ref
seq: C: mut seq: G: mut aa: p.E47D: mutation info source: CCLE: ref target(-10 +10):
CTCCCCCTATC̲TCTCGCCGGG (SEQ ID NO: 2134): mut target(-10 +10):
CTCCCCCTATG̲TCTCGCCGGG (SEQ ID NO: 2135): [Model Cell line information]: cell: NCIH1573:
cancer type: LUNG: PAM dist: 9: indel length: 0: CRISPR gRNA ID: GF-CCELg9-510: [crRNA sequence]:
crRNA sequence: GCGAGAC̲ATAGGGGGAGGGGAGG (SEQ ID NO: 2144):
SpgRNA: attctaatacgactcactataggGCGAGACATAGGGGGAGGGGAGGgttttagagctagaaatagcaagttaaaataaggctagtccg
ttatcaacttgaaaaagtggcaccgagtcggtgtgc (SEQ ID NO: 2145): [Target gene information]: Gene ID: 4170:
Symbol: MCL1: Ensembl Transcript ID: EN5T00000369026.2: GRCh: 37: Chr: 1: [Target cancer mutation
information]: mut start: 150551866: mut end: 150551866: mut class: Missense Mutation: mut type: SNP: ref
seq: C: mut seq: G: mut aa: p.E47D: mutation info source: CCLE: ref target(-10 +10):
CTCCCCCTATC̲TCTCGCCGGG (SEQ ID NO: 2134): mut target(-10 +10):
CTCCCCCTATG̲TCTCGCCGGG (SEQ ID NO: 2135): [Model Cell line information]: cell: NCIH1573:
cancer type: LUNG: PAM dist: 14: indel length: 0: CRISPR gRNA ID: GF-CCELg9-511: [crRNA sequence]:
crRNA sequence: GAC̲ATAGGGGGAGGGGAGGCGG (SEQ ID NO: 2146):
SpgRNA: attctaatacgactcactataggGACATAGGGGGAGGGGAGGCGgttttagagctagaaatagcaagttaaaataaggctagtccg
ttatcaacttgaaaaagtggcaccgagtcggtgc (SEQ ID NO: 2147): [Target gene information]: Gene ID: 4170:
Symbol: MCL1: Ensembl Transcript ID: EN5T00000369026.2: GRCh: 37: Chr: 1: [Target cancer mutation TABLE 7-continued Illustrative guide RNA sequences for polypeptides comprising Cas9 information]: mut start: 150551866: mut end: 150551866: mut class: Missense Mutation: mut type: SNP: ref
seq: C: mut seq: G: mut aa: p.E47D: mutation info source: CCLE: ref target(-10 +10):
CTCCCCCTATCTCTCGCCGGG (SEQ ID NO: 2134): mut target(-10 +10):
CTCCCCCTATGTCTCGCCGGG (SEQ ID NO: 2135): [Model Cell line information]: cell: NCIH1573:
cancer type: LUNG: PAM dist: 18: indel length: 0: CRISPR gRNA ID: GF-CCELg9-512: [crRNA sequence]:
crRNA sequence: CCTCGGCCCGGCGAGACATAGGG (SEQ ID NO: 2148):
SpgRNA: attctaatacgactcactataggCCTCGGCCCGGCGAGACATAGgttttagagctagaaatagcaagttaaaataaggctagtccgtt
atcaacttgaaaaagtggcaccgagtcggtgc (SEQ ID NO: 2149): [Target gene information]: Gene ID: 4170: Symbol:
MCL1: Ensembl Transcript ID: EN5T00000369026.2: GRCh: 37: Chr: 1: [Target cancer mutation
information]: mut start: 150551866: mut end: 150551866: mut class: Missense Mutation: mut type: SNP: ref
seq: C: mut seq: G: mut aa: p.E47D: mutation info source: CCLE: ref target(-10 +10):
CTCCCCCTATCTCTCGCCGGG (SEQ ID NO: 2134): mut target(-10 +10):
CTCCCCCTATGTCTCGCCGGG (SEQ ID NO: 2135): [Model Cell line information]: cell: NCIH1573:
cancer type: LUNG: PAM dist: 4: indel length: 0: CRISPR gRNA ID: GF-CCELg9-513: [crRNA sequence]:
crRNA sequence: CTCGGCCCGGCGAGACATAGGGG (SEQ ID NO: 2150):
SpgRNA: attctaatacgactcactataggCTCGGCCCGGCGAGACATAGgttttagagctagaaatagcaagttaaaataaggctagtccgt
tatcaacttgaaaaagtggcaccgagtcggtgc (SEQ ID NO: 2151): [Target gene information]: Gene ID: 4170: Symbol:
MCL1: Ensembl Transcript ID: ENST00000369026.2: GRCh: 37: Chr: 1: [Target cancer mutation
information]: mut start: 150551866: mut end: 150551866: mut class: Missense Mutation: mut type: SNP: ref
seq: C: mut seq: G: mut aa: p.E47D: mutation info source: CCLE: ref target(-10 +10):
CTCCCCCTATCTCTCGCCGGG (SEQ ID NO: 2134): mut target(-10 +10):
CTCCCCCTATGTCTCGCCGGG (SEQ ID NO: 2135): [Model Cell line information]: cell: NCIH1573:
cancer type: LUNG: PAM dist: 5: indel length: 0: CRISPR gRNA ID: GF-CCELg9-514: [crRNA sequence]:
crRNA sequence: TCGGCCCGGCGAGACATAGGGGG (SEQ ID NO: 2152):
SpgRNA: attctaatacgactcactataggTCGGCCCGGCGAGACATAGGgttttagagctagaaatagcaagttaaaataaggctagtccgt
tatcaacttgaaaaagtggcaccgagtcggtgc (SEQ ID NO: 2153): [Target gene information]: Gene ID: 4170: Symbol:
MCL1: Ensembl Transcript ID: EN5T00000369026.2: GRCh: 37: Chr: 1: [Target cancer mutation
information]: mut start: 150551866: mut end: 150551866: mut class: Missense Mutation: mut type: SNP: ref
seq: C: mut seq: G: mut aa: p.E47D: mutation info source: CCLE: ref target(-10 +10):
CTCCCCCTATCTCTCGCCGGG (SEQ ID NO: 2134): mut target(-10 +10):
CTCCCCCTATGTCTCGCCGGG (SEQ ID NO: 2135): [Model Cell line information]: cell: NCIH1573:
cancer type: LUNG: PAM dist: 6: indel length: 0: CRISPR gRNA ID: GF-CCELg9-515: [crRNA sequence]:
crRNA sequence: CCCGGCGAGACATAGGGGGAGGG (SEQ ID NO: 2154):
SpgRNA: attctaatacgactcactataggCCCGGCGAGACATAGGGGGAGgttttagagctagaaatagcaagttaaaataaggctagtccgt
tatcaacttgaaaaagtggcaccgagtcggtgc (SEQ ID NO: 2155): [Target gene information]: Gene ID: 4170: Symbol:
MCL1: Ensembl Transcript ID: EN5T00000369026.2: GRCh: 37: Chr: 1: [Target cancer mutation
information]: mut start: 150551866: mut end: 150551866: mut class: Missense Mutation: mut type: SNP: ref
seq: C: mut seq: G: mut aa: p.E47D: mutation info source: CCLE: ref target(-10 +10):
CTCCCCCTATCTCTCGCCGGG (SEQ ID NO: 2134): mut target(-10 +10):
CTCCCCCTATGTCTCGCCGGG (SEQ ID NO: 2135): [Model Cell line information]: cell: NCIH1573:
cancer type: LUNG: PAM dist: 10: indel length: 0: CRISPR gRNA ID: GF-CCELg9-516: [crRNA sequence]:
crRNA sequence: CCGGCGAGACATAGGGGGAGGGG (SEQ ID NO: 2156):
SpgRNA: attctaatacgactcactataggCCGGCGAGACATAGGGGGAGgttttagagctagaaatagcaagttaaaataaggctagtccg
ttatcaacttgaaaaagtggcaccgagtcggtgc (SEQ ID NO: 2157): [Target gene information]: Gene ID: 4170:
Symbol: MCL1: Ensembl Transcript ID: EN5T00000369026.2: GRCh: 37: Chr: 1: [Target cancer mutation
information]: mut start: 150551866: mut end: 150551866: mut class: Missense Mutation: mut type: SNP: ref
seq: C: mut seq: G: mut aa: p.E47D: mutation info source: CCLE: ref target(-10 +10):
CTCCCCCTATCTCTCGCCGGG (SEQ ID NO: 2134): mut target(-10 +10):
CTCCCCCTATGTCTCGCCGGG (SEQ ID NO: 2135): [Model Cell line information]: cell: NCIH1573:
cancer type: LUNG: PAM dist: 11: indel length: 0: CRISPR gRNA ID: GF-CCELg9-517: [crRNA sequence]:
crRNA sequence: GCGCCTTCGCCAACAGCTCCAGG (SEQ ID NO: 2158):
SpgRNA: attctaatacgactcactataggGCGCCTTCGCCAACAGCTCCttttagagctagaaatagcaagttaaaataaggctagtccgtt
atcaacttgaaaaagtggcaccgagtcggtgc (SEQ ID NO: 2159): [Target gene information]: Gene ID: 9968: Symbol:
MED12: Ensembl Transcript ID: EN5T00000374080.3: GRCh: 37: Chr: X: [Target cancer mutation
information]: mut start: 70357233: mut end: 70357262: mut class: Splice Site: mut type: DEL: ref seq:
GGCAAAGATAGTGAGAGGGGCAGTAGGGAG (SEQ ID NO: 2160): mut seq: -: mut aa: p.Q1917del:
mutation info source: CCLE ref target(-10 +10):
AACAGCTCCAGGCAAAGATAGTGAGAGGGGCAGTAGGGAGGGCTGTCAGG (SEQ ID NO:
2161): mut target(-10 +10): AACAGCTCCA-------------------------------GGCTGTCAGG (SEQ ID NO: 2162):
[Model Cell line information]: cell: NCIH1650: cancer type: LUNG: PAM dist: 0: indel length: 30: CRISPR
gRNA ID: GF-CCELg9-518: [crRNA sequence]: crRNA sequence: GCCAACAGCTCCAGGCTGTCAGG
(SEQ ID NO: 2163):
SpgRNA: attctaatacgactcactataggGCCAACAGCTCCAGGCTGTCgttttagagctagaaatagcaagttaaaataaggctagtccgtt
atcaacttgaaaaagtggcaccgagtcggtgc (SEQ ID NO: 2164): [Target gene information]: Gene ID: 9968: Symbol:
MED12: Ensembl Transcript ID: EN5T00000374080.3: GRCh: 37: Chr: X: [Target cancer mutation
information]: mut start: 70357233: mut end: 70357262: mut class: Splice Site: mut type: DEL: ref seq:
GGCAAAGATAGTGAGAGGGGCAGTAGGGAG (SEQ ID NO: 2160): mut seq: -: mut aa: p.Q1917del:
mutation info source: CCLE ref target(-10 +10):
AACAGCTCCAGGCAAAGATAGTGAGAGGGGCAGTAGGGAGGGCTGTCAGG (SEQ ID NO:
2161): mut target(-10 +10): AACAGCTCCA-------------------------------GGCTGTCAGG (SEQ ID NO: 2162):
[Model Cell line information]: cell: NCIH1650: cancer type: LUNG: PAM dist: 8: indel length: 30: CRISPR
gRNA ID: GF-CCELg9-519: [crRNA sequence]: crRNA sequence: AGCTCCAGGCTGTCAGGGAGAGG
(SEQ ID NO: 2165):
SpgRNA: attctaatacgactcactataggAGCTCCAGGCTGTCAGGGAGgttttagagctagaaatagcaagttaaaataaggctagtccgt
tatcaacttgaaaaagtggcaccgagtcggtgc (SEQ ID NO: 2166): [Target gene information]: Gene ID: 9968: Symbol:
MED12: Ensembl Transcript ID: EN5T00000374080.3: GRCh: 37: Chr: X: [Target cancer mutation
information]: mut start: 70357233: mut end: 70357262: mut class: Splice Site: mut type: DEL: ref seq:
GGCAAAGATAGTGAGAGGGGCAGTAGGGAG (SEQ ID NO: 2160): mut seq: -: mut aa: p.Q1917del:

TABLE 7-continued

Illustrative guide RNA sequences for polypeptides comprising Cas9 mutation info source: CCLE ref target(-10 +10):
AACAGCTCCAGGCAAAGATAGTGAGAGGGGCAGTAGGGAGGGCTGTCAGG (SEQ ID NO:
2161): mut target(-10 +10): AACAGCTCCA--------------------------------GGCTGTCAGG (SEQ ID NO: 2162):
[Model Cell line information]: cell: NCIH1650: cancer type: LUNG: PAM dist: 14: indel length: 30:
CRISPR gRNA ID: GF-CCELg9-520: [crRNA sequence]: crRNA sequence:
CCAACAGCTCCAGGCTGTCAGGG (SEQ ID NO: 2167):
SpgRNA: attctaatacgactcactataggCCAACAGCTCCAGGCTGTCAGgttttagagctagaaatagcaagttaaaataaggctagtccgtt
atcaacttgaaaaagtggcaccgagtcggtgc (SEQ ID NO: 2168): [Target gene information]: Gene ID: 9968: Symbol:
MED12: Ensembl Transcript ID: EN5T00000374080.3: GRCh: 37: Chr: X: [Target cancer mutation
information]: mut start: 70357233: mut end: 70357262: mut class: Splice Site: mut type: DEL: ref seq:
GGCAAAGATAGTGAGAGGGGCAGTAGGGAG (SEQ ID NO: 2160): mut seq: -: mut aa: p.Q1917del:
mutation info source: CCLE ref target(-10 +10):
AACAGCTCCAGGCAAAGATAGTGAGAGGGGCAGTAGGGAGGGCTGTCAGG (SEQ ID NO:
2161): mut target(-10 +10): AACAGCTCCA--------------------------------GGCTGTCAGG (SEQ ID NO: 2162):
[Model Cell line information]: cell: NCIH1650: cancer type: LUNG: PAM dist: 9: indel length: 30: CRISPR
gRNA ID: GF-CCELg9-521: [crRNA sequence]: crRNA sequence: GCTCCAGGCTGTCAGGGAGAGGG
(SEQ ID NO: 2169):
SpgRNA: attctaatacgactcactataggGCTCCAGGCTGTCAGGGAGAgttttagagctagaaatagcaagttaaaataaggctagtccgt
tatcaacttgaaaaagtggcaccgagtcggtgc (SEQ ID NO: 2170): [Target gene information]: Gene ID: 9968: Symbol:
MED12: Ensembl Transcript ID: EN5T00000374080.3: GRCh: 37: Chr: X: [Target cancer mutation
information]: mut start: 70357233: mut end: 70357262: mut class: Splice Site: mut type: DEL: ref seq:
GGCAAAGATAGTGAGAGGGGCAGTAGGGAG (SEQ ID NO: 2160): mut seq: -: mut aa: p.Q1917del:
mutation info source: CCLE ref target(-10 +10):
AACAGCTCCAGGCAAAGATAGTGAGAGGGGCAGTAGGGAGGGCTGTCAGG (SEQ ID NO:
2161): mut target(-10 +10): AACAGCTCCA--------------------------------GGCTGTCAGG (SEQ ID NO: 2162):
[Model Cell line information]: cell: NCIH1650: cancer type: LUNG: PAM dist: 15: indel length: 30:
CRISPR gRNA ID: GF-CCELg9-522: [crRNA sequence]: crRNA sequence:
CTCCAGGCTGTCAGGGAGAGGGG (SEQ ID NO: 2171):
SpgRNA: attctaatacgactcactataggCTCCAGGCTGTCAGGGAGAGgttttagagctagaaatagcaagttaaaataaggctagtccgt
tatcaacttgaaaaagtggcaccgagtcggtgc (SEQ ID NO: 2172): [Target gene information]: Gene ID: 9968: Symbol:
MED12: Ensembl Transcript ID: EN5T00000374080.3: GRCh: 37: Chr: X: [Target cancer mutation
information]: mut start: 70357233: mut end: 70357262: mut class: Splice Site: mut type: DEL: ref seq:
GGCAAAGATAGTGAGAGGGGCAGTAGGGAG (SEQ ID NO: 2160): mut seq: -: mut aa: p.Q1917del:
mutation info source: CCLE ref target(-10 +10):
AACAGCTCCAGGCAAAGATAGTGAGAGGGGCAGTAGGGAGGGCTGTCAGG (SEQ ID NO:
2161): mut target(-10 +10): AACAGCTCCA--------------------------------GGCTGTCAGG (SEQ ID NO: 2162):
[Model Cell line information]: cell: NCIH1650: cancer type: LUNG: PAM dist: 16: indel length: 30:
CRISPR gRNA ID: GF-CCELg9-523: [crRNA sequence]: crRNA sequence:
CAGCCTGGAGCTGTTGGCGAAGG (SEQ ID NO: 2173):
SpgRNA: attctaatacgactcactataggCAGCCTGGAGCTGTTGGCGAgttttagagctagaaatagcaagttaaaataaggctagtccgtt
atcaacttgaaaaagtggcaccgagtcggtgc (SEQ ID NO: 2174): [Target gene information]: Gene ID: 9968: Symbol:
MED12: Ensembl Transcript ID: EN5T00000374080.3: GRCh: 37: Chr: X: [Target cancer mutation
information]: mut start: 70357233: mut end: 70357262: mut class: Splice Site: mut type: DEL: ref seq:
GGCAAAGATAGTGAGAGGGGCAGTAGGGAG (SEQ ID NO: 2160): mut seq: -: mut aa: p.Q1917del:
mutation info source: CCLE ref target(-10 +10):
AACAGCTCCAGGCAAAGATAGTGAGAGGGGCAGTAGGGAGGGCTGTCAGG (SEQ ID NO:
2161): mut target(-10 +10): AACAGCTCCA--------------------------------GGCTGTCAGG (SEQ ID NO: 2162):
[Model Cell line information]: cell: NCIH1650: cancer type: LUNG: PAM dist: 16: indel length: 30:
CRISPR gRNA ID: GF-CCELg9-524: [crRNA sequence]: crRNA sequence:
AGCCCCTCTCCCTGACAGCCTGG (SEQ ID NO: 2175):
SpgRNA: attctaatacgactcactataggAGCCCCTCTCCCTGACAGCCgttttagagctagaaatagcaagttaaaataaggctagtccgtt
atcaacttgaaaaagtggcaccgagtcggtgc (SEQ ID NO: 2176): [Target gene information]: Gene ID: 9968: Symbol:
MED12: Ensembl Transcript ID: EN5T00000374080.3: GRCh: 37: Chr: X: [Target cancer mutation
information]: mut start: 70357233: mut end: 70357262: mut class: Splice Site: mut type: DEL: ref seq:
GGCAAAGATAGTGAGAGGGGCAGTAGGGAG (SEQ ID NO: 2160): mut seq: -: mut aa: p.Q1917del:
mutation info source: CCLE ref target(-10 +10):
AACAGCTCCAGGCAAAGATAGTGAGAGGGGCAGTAGGGAGGGCTGTCAGG (SEQ ID NO:
2161): mut target(-10 +10): AACAGCTCCA--------------------------------GGCTGTCAGG (SEQ ID NO: 2162):
[Model Cell line information]: cell: NCIH1650: cancer type: LUNG: PAM dist: 1: indel length: 30: CRISPR
gRNA ID: GF-CCELg9-525: [crRNA sequence]: crRNA sequence: CCCTGACAGCCTGGAGCTGTTGG
(SEQ ID NO: 2177):
SpgRNA: attctaatacgactcactataggCCCTGACAGCCTGGAGCTGTgttttagagctagaaatagcaagttaaaataaggctagtccgtt
atcaacttgaaaaagtggcaccgagtcggtgc (SEQ ID NO: 2178): [Target gene information]: Gene ID: 9968: Symbol:
MED12: Ensembl Transcript ID: EN5T00000374080.3: GRCh: 37: Chr: X: [Target cancer mutation
information]: mut start: 70357233: mut end: 70357262: mut class: Splice Site: mut type: DEL: ref seq:
GGCAAAGATAGTGAGAGGGGCAGTAGGGAG (SEQ ID NO: 2160): mut seq: -: mut aa: p.Q1917del:
mutation info source: CCLE ref target(-10 +10):
AACAGCTCCAGGCAAAGATAGTGAGAGGGGCAGTAGGGAGGGCTGTCAGG (SEQ ID NO:
2161): mut target(-10 +10): AACAGCTCCA--------------------------------GGCTGTCAGG (SEQ ID NO: 2162):
[Model Cell line information]: cell: NCIH1650: cancer type: LUNG: PAM dist: 10: indel length: 30:
CRISPR gRNA ID: GF-CCELg9-526: [crRNA sequence]: crRNA sequence:
AGAAATCAGTCCCCATAATGTGG (SEQ ID NO: 2179):
SpgRNA: attctaatacgactcactataggAGAAATCAGTCCCCATAATGgttttagagctagaaatagcaagttaaaataaggctagtccgtt
atcaacttgaaaaagtggcaccgagtcggtgc (SEQ ID NO: 2180): [Target gene information]: Gene ID: 4292: Symbol:
MLH1: Ensembl Transcript ID: ENST00000231790.2: GRCh: 37: Chr: 3: [Target cancer mutation
information]: mut start: 37061819: mut end: 37061819: mut class: Missense Mutation: mut type: SNP: ref
seq: G: mut seq: T: mut aa: p.Q301H: mutation info source: CCLE: ref target(-10 +10):
TCAGTCCCCAGAATGTGGATG (SEQ ID NO: 593): mut target(-10 +10):

TABLE 7-continued

Illustrative guide RNA sequences for polypeptides comprising Cas9

TCAGTCCCCATAATGTGGATG (SEQ ID NO: 594): [Model Cell line information]: cell: NCIH1573:
cancer type: LUNG: PAM dist: 5: indel length: 0: CRISPR gRNA ID: GF-CCELg9-527: [crRNA sequence]:
crRNA sequence: GCACATTAACATCCACATTATGG (SEQ ID NO: 2181):
SpgRNA: attctaatacgactcactataggGCACATTAACATCCACATTAgttttagagctagaaatagcaagttaaaataaggctagtccgtt
atcaacttgaaaaagtggcaccgagtcggtgc (SEQ ID NO: 2182): [Target gene information]: Gene ID: 4292: Symbol:
MLH1: Ensembl Transcript ID: ENST00000231790.2: GRCh: 37: Chr: 3: [Target cancer mutation
information]: mut start: 37061819: mut end: 37061819: mut class: Missense Mutation: mut type: SNP: ref
seq: G: mut seq: T: mut aa: p.Q301H: mutation info source: CCLE: ref target(-10 +10):
TCAGTCCCCAGAATGTGGATG (SEQ ID NO: 593): mut target(-10 +10):
TCAGTCCCCATAATGTGGATG (SEQ ID NO: 594): [Model Cell line information]: cell: NCIH1573:
cancer type: LUNG: PAM dist: 1: indel length: 0: CRISPR gRNA ID: GF-CCELg9-528: [crRNA sequence]:
crRNA sequence: CACATTAACATCCACATTATGGG (SEQ ID NO: 2183):
SpgRNA: attctaatacgactcactataggCACATTAACATCCACATTATgttttagagctagaaatagcaagttaaaataaggctagtccgtt
atcaacttgaaaaagtggcaccgagtcggtgc (SEQ ID NO: 2184): [Target gene information]: Gene ID: 4292: Symbol:
MLH1: Ensembl Transcript ID: ENST00000231790.2: GRCh: 37: Chr: 3: [Target cancer mutation
information]: mut start: 37061819: mut end: 37061819: mut class: Missense Mutation: mut type: SNP: ref
seq: G: mut seq: T: mut aa: p.Q301H: mutation info source: CCLE: ref target(-10 +10):
TCAGTCCCCAGAATGTGGATG (SEQ ID NO: 593): mut target(-10 +10):
TCAGTCCCCATAATGTGGATG (SEQ ID NO: 594): [Model Cell line information]: cell: NCIH1573:
cancer type: LUNG: PAM dist: 2: indel length: 0: CRISPR gRNA ID: GF-CCELg9-529: [crRNA sequence]:
crRNA sequence: ACATTAACATCCACATTATGGGG (SEQ ID NO: 2185):
SpgRNA: attctaatacgactcactataggACATTAACATCCACATTATGgttttagagctagaaatagcaagttaaaataaggctagtccgtt
atcaacttgaaaaagtggcaccgagtcggtgc (SEQ ID NO: 2186): [Target gene information]: Gene ID: 4292: Symbol:
MLH1: Ensembl Transcript ID: ENST00000231790.2: GRCh: 37: Chr: 3: [Target cancer mutation
information]: mut start: 37061819: mut end: 37061819: mut class: Missense Mutation: mut type: SNP: ref
seq: G: mut seq: T: mut aa: p.Q301H: mutation info source: CCLE: ref target(-10 +10):
TCAGTCCCCAGAATGTGGATG (SEQ ID NO: 593): mut target(-10 +10):
TCAGTCCCCATAATGTGGATG (SEQ ID NO: 594): [Model Cell line information]: cell: NCIH1573:
cancer type: LUNG: PAM dist: 3: indel length: 0: CRISPR gRNA ID: GF-CCELg9-530: [crRNA sequence]:
crRNA sequence: TCCTGGGCTCCAATTCCTCGAGG (SEQ ID NO: 2187):
SpgRNA: attctaatacgactcactataggTCCTGGGCTCCAATTCCTCGgittttagagctagaaatagcaagttaaaataaggctagtccgtta
tcaacttgaaaaagtggcaccgagtcggtgc (SEQ ID NO: 2188): [Target gene information]: Gene ID: 4292: Symbol:
MLH1: Ensembl Transcript ID: ENST00000231790.2: GRCh: 37: Chr: 3: [Target cancer mutation
information]: mut start: 37061936: mut end: 37061936: mut class: Silent: mut type: SNP: ref seq: C: mut
seq: G: mut aa: p.S340S: mutation info source: CCLE: ref target(-10 +10): CCAATTCCTCCAGGATGTACT
(SEQ ID NO: 2189): mut target(-10 +10): CCAATTCCTCGAGGATGTACT (SEQ ID NO: 2190): [Model
Cell line information]: cell: HPAFII: cancer type: PANCREAS: PAM dist: 1: indel length: 0: CRISPR gRNA
ID: GF-CCELg9-531: [crRNA sequence]: crRNA sequence: CTCGAGGATGTACTTCACCCAGG (SEQ ID
NO: 2191):
SpgRNA: attctaatacgactcactataggCTCGAGGATGTACTTCACCCgttttagagctagaaatagcaagttaaaataaggctagtccgtt
atcaacttgaaaaagtggcaccgagtcggtgc (SEQ ID NO: 2192): [Target gene information]: Gene ID: 4292: Symbol:
MLH1: Ensembl Transcript ID: ENST00000231790.2: GRCh: 37: Chr: 3: [Target cancer mutation
information]: mut start: 37061936: mut end: 37061936: mut class: Silent: mut type: SNP: ref seq: C: mut
seq: G: mut aa: p.S340S: mutation info source: CCLE: ref target(-10 +10): CCAATTCCTCCAGGATGTACT
(SEQ ID NO: 2189): mut target(-10 +10): CCAATTCCTCGAGGATGTACT (SEQ ID NO: 2190): [Model
Cell line information]: cell: HPAFII: cancer type: PANCREAS: PAM dist: 17: indel length: 0: CRISPR
gRNA ID: GF-CCELg9-532: [crRNA sequence]: crRNA sequence: CTGGGTGAAGTACATCCTCGAGG
(SEQ ID NO: 2193):
SpgRNA: attctaatacgactcactataggCTGGGTGAAGTACATCCTCGgttttagagctagaaatagcaagttaaaataaggctagtccgtt
atcaacttgaaaaagtggcaccgagtcggtgc (SEQ ID NO: 2194): [Target gene information]: Gene ID: 4292: Symbol:
MLH1: Ensembl Transcript ID: ENST00000231790.2: GRCh: 37: Chr: 3: [Target cancer mutation
information]: mut start: 37061936: mut end: 37061936: mut class: Silent: mut type: SNP: ref seq: C: mut
seq: G: mut aa: p.S340S: mutation info source: CCLE: ref target(-10 +10): CCAATTCCTCCAGGATGTACT
(SEQ ID NO: 2189): mut target(-10 +10): CCAATTCCTCGAGGATGTACT (SEQ ID NO: 2190): [Model
Cell line information]: cell: HPAFII: cancer type: PANCREAS: PAM dist: 2: indel length: 0: CRISPR gRNA
ID: GF-CCELg9-533: [crRNA sequence]: crRNA sequence: TCCTCGAGGAATTGGAGCCCAGG (SEQ ID
NO: 2195):
SpgRNA: attctaatacgactcactataggTCCTCGAGGAATTGGAGCCCgttttagagctagaaatagcaagttaaaataaggctagtccgtt
atcaacttgaaaaagtggcaccgagtcggtgc (SEQ ID NO: 2196): [Target gene information]: Gene ID: 4292: Symbol:
MLH1: Ensembl Transcript ID: ENST00000231790.2: GRCh: 37: Chr: 3: [Target cancer mutation
information]: mut start: 37061936: mut end: 37061936: mut class: Silent: mut type: SNP: ref seq: C: mut
seq: G: mut aa: p.S340S: mutation info source: CCLE: ref target(-10 +10): CCAATTCCTCCAGGATGTACT
(SEQ ID NO: 2189): mut target(-10 +10): CCAATTCCTCGAGGATGTACT (SEQ ID NO: 2190): [Model
Cell line information]: cell: HPAFII: cancer type: PANCREAS: PAM dist: 16: indel length: 0: CRISPR
gRNA ID: GF-CCELg9-534: [crRNA sequence]: crRNA sequence: GAAGTACATCCTCGAGGAATTGG
(SEQ ID NO: 2197):
SpgRNA: attctaatacgactcactataggGAAGTACATCCTCGAGGAATgagagctagaaatagcaagttaaaataaggctagtccgtt
atcaacttgaaaaagtggcaccgagtcggtgc (SEQ ID NO: 2198): [Target gene information]: Gene ID: 4292: Symbol:
MLH1: Ensembl Transcript ID: ENST00000231790.2: GRCh: 37: Chr: 3: [Target cancer mutation
information]: mut start: 37061936: mut end: 37061936: mut class: Silent: mut type: SNP: ref seq: C: mut
seq: G: mut aa: p.S340S: mutation info source: CCLE: ref target(-10 +10): CCAATTCCTCCAGGATGTACT
(SEQ ID NO: 2189): mut target(-10 +10): CCAATTCCTCGAGGATGTACT (SEQ ID NO: 2190): [Model
Cell line information]: cell: HPAFII: cancer type: PANCREAS: PAM dist: 8: indel length: 0: CRISPR gRNA
ID: GF-CCELg9-535: [crRNA sequence]: crRNA sequence: GCGCTCTGCGTCACCGCCCAAGG (SEQ ID
NO: 2199):
SpgRNA: attctaatacgactcactataggGCGCTCTGCGTCACCGCCCAgttttagagctagaaatagcaagttaaaataaggctagtccgtt
atcaacttgaaaaagtggcaccgagtcggtgc (SEQ ID NO: 2200): [Target gene information]: Gene ID: 2956: Symbol:
MSH6: Ensembl Transcript ID: EN5T00000234420.5: GRCh: 37: Chr: 2: [Target cancer mutation TABLE 7-continued Illustrative guide RNA sequences for polypeptides comprising Cas9 information]: mut start: 48010561: mut end: 48010561: mut class: Silent: mut type: SNP: ref seq: C: mut
seq: T: mut aa: p.S635: mutation info source: CCLE: ref target(-10 +10): TGGCGCGCTCCGCGTCACCGC
(SEQ ID NO: 2201): mut target(-10 +10): TGGCGCGCTCTGCGTCACCGC (SEQ ID NO: 2202): [Model
Cell line information]: cell: NCIH1563: cancer type: LUNG: PAM dist: 14: indel length: 0: CRISPR gRNA
ID: GF-CCELg9-536: [crRNA sequence]: crRNA sequence: CGGTGACGCAGAGCGCGCCAAGG (SEQ ID
NO: 2203):
SpgRNA: attctaatacgactcactataggCGGTGACGCAGAGCGCGCCAGttttagagctagaaatagcaagttaaaataaggctagtccgt
tatcaacttgaaaaagtggcaccgagtcggtgc (SEQ ID NO: 2204): [Target gene information]: Gene ID: 2956: Symbol:
MSH6: Ensembl Transcript ID: ENST00000234420.5: GRCh: 37: Chr: 2: [Target cancer mutation
information]: mut start: 48010561: mut end: 48010561: mut class: Silent: mut type: SNP: ref seq: C: mut
seq: T: mut aa: p.S635: mutation info source: CCLE: ref target(-10 +10): TGGCGCGCTCCGCGTCACCGC
(SEQ ID NO: 2201): mut target(-10 +10): TGGCGCGCTCTGCGTCACCGC (SEQ ID NO: 2202): [Model
Cell line information]: cell: NCIH1563: cancer type: LUNG: PAM dist: 11: indel length: 0: CRISPR gRNA
ID: GF-CCELg9-537: [crRNA sequence]: crRNA sequence: CGCAGAGCGCGCCAAGGGCCTGG (SEQ ID
NO: 2205):
SpgRNA: attctaatacgactcactataggCGCAGAGCGCGCCAAGGGCCGttttagagctagaaatagcaagttaaaataaggctagtccgt
tatcaacttgaaaaagtggcaccgagtcggtgc (SEQ ID NO: 2206): [Target gene information]: Gene ID: 2956: Symbol:
MSH6: Ensembl Transcript ID: EN5T00000234420.5: GRCh: 37: Chr: 2: [Target cancer mutation
information]: mut start: 48010561: mut end: 48010561: mut class: Silent: mut type: SNP: ref seq: C: mut
seq: T: mut aa: p.S635: mutation info source: CCLE: ref target(-10 +10): TGGCGCGCTCCGCGTCACCGC
(SEQ ID NO: 2201): mut target(-10 +10): TGGCGCGCTCTGCGTCACCGC (SEQ ID NO: 2202): [Model
Cell line information]: cell: NCIH1563: cancer type: LUNG: PAM dist: 17: indel length: 0: CRISPR gRNA
ID: GF-CCELg9-538: [crRNA sequence]: crRNA sequence: GGTGACGCAGAGCGCGCCAAGGG (SEQ
ID NO: 2207):
SpgRNA: attctaatacgactcactataggGGTGACGCAGAGCGCGCCAAg agagctagaaatagcaagttaaaataaggctagtccgt
tatcaacttgaaaaagtggcaccgagtcggtgc (SEQ ID NO: 2208): [Target gene information]: Gene ID: 2956: Symbol:
MSH6: Ensembl Transcript ID: EN5T00000234420.5: GRCh: 37: Chr: 2: [Target cancer mutation
information]: mut start: 48010561: mut end: 48010561: mut class: Silent: mut type: SNP: ref seq: C: mut
seq: T: mut aa: p.S635: mutation info source: CCLE: ref target(-10 +10): TGGCGCGCTCCGCGTCACCGC
(SEQ ID NO: 2201): mut target(-10 +10): TGGCGCGCTCTGCGTCACCGC (SEQ ID NO: 2202): [Model
Cell line information]: cell: NCIH1563: cancer type: LUNG: PAM dist: 12: indel length: 0: CRISPR gRNA
ID: GF-CCELg9-539: [crRNA sequence]: crRNA sequence: GCAGAGCGCGCCAAGGGCCTGGG (SEQ ID
NO: 2209):
SpgRNA: attctaatacgactcactataggGCAGAGCGCGCCAAGGGCCTgttttagagctagaaatagcaagttaaaataaggctagtccgt
tatcaacttgaaaaagtggcaccgagtcggtgc (SEQ ID NO: 2210): [Target gene information]: Gene ID: 2956: Symbol:
MSH6: Ensembl Transcript ID: EN5T00000234420.5: GRCh: 37: Chr: 2: [Target cancer mutation
information]: mut start: 48010561: mut end: 48010561: mut class: Silent: mut type: SNP: ref seq: C: mut
seq: T: mut aa: p.S635: mutation info source: CCLE: ref target(-10 +10): TGGCGCGCTCCGCGTCACCGC
(SEQ ID NO: 2201): mut target(-10 +10): TGGCGCGCTCTGCGTCACCGC (SEQ ID NO: 2202): [Model
Cell line information]: cell: NCIH1563: cancer type: LUNG: PAM dist: 18: indel length: 0: CRISPR gRNA
ID: GF-CCELg9-540: [crRNA sequence]: crRNA sequence: GGGTGGGCTGTGAGATCACCAGG (SEQ ID
NO: 2211):
SpgRNA: attctaatacgactcactataggGGGTGGGCTGTGAGATCACCg agagctagaaatagcaagttaaaataaggctagtccgtt
atcaacttgaaaaagtggcaccgagtcggtgc (SEQ ID NO: 2212): [Target gene information]: Gene ID: 4595: Symbol:
MUTYH: Ensembl Transcript ID: EN5T00000372098.3: GRCh: 37: Chr: 1: [Target cancer mutation
information]: mut start: 45798247: mut end: 45798247: mut class: Splice Site: mut type: SNP: ref seq: T:
mut seq: A: mut aa: p.Q227L: mutation info source: CCLE: ref target(-10 +10):
TGAGATCACCTGGCCAAAGGC (SEQ ID NO: 605): mut target(-10 +10):
TGAGATCACCAGGCCAAAGGC (SEQ ID NO: 606): [Model Cell line information]: cell: NCIH1573:
cancer type: LUNG: PAM dist: 0: indel length: 0: CRISPR gRNA ID: GF-CCELg9-541: [crRNA sequence]:
crRNA sequence: CTGTGAGATCACCAGGCCAAAGG (SEQ ID NO: 2213):
SpgRNA: attctaatacgactcactataggCTGTGAGATCACCAGGCCAAgttttagagctagaaatagcaagttaaaataaggctagtccgtt
atcaacttgaaaaagtggcaccgagtcggtgc (SEQ ID NO: 2214): [Target gene information]: Gene ID: 4595: Symbol:
MUTYH: Ensembl Transcript ID: EN5T00000372098.3: GRCh: 37: Chr: 1: [Target cancer mutation
information]: mut start: 45798247: mut end: 45798247: mut class: Splice Site: mut type: SNP: ref seq: T:
mut seq: A: mut aa: p.Q227L: mutation info source: CCLE: ref target(-10 +10):
TGAGATCACCTGGCCAAAGGC (SEQ ID NO: 605): mut target(-10 +10):
TGAGATCACCAGGCCAAAGGC (SEQ ID NO: 606): [Model Cell line information]: cell: NCIH1573:
cancer type: LUNG: PAM dist: 7: indel length: 0: CRISPR gRNA ID: GF-CCELg9-542: [crRNA sequence]:
crRNA sequence: CACCAGGCCAAAGGCGATAGAGG (SEQ ID NO: 2215):
SpgRNA: attctaatacgactcactataggCACCAGGCCAAAGGCGATAGgttttagagctagaaatagcaagttaaaataaggctagtccgt
tatcaacttgaaaaagtggcaccgagtcggtgc (SEQ ID NO: 2216): [Target gene information]: Gene ID: 4595: Symbol:
MUTYH: Ensembl Transcript ID: EN5T00000372098.3: GRCh: 37: Chr: 1: [Target cancer mutation
information]: mut start: 45798247: mut end: 45798247: mut class: Splice Site: mut type: SNP: ref seq: T:
mut seq: A: mut aa: p.Q227L: mutation info source: CCLE: ref target(-10 +10):
TGAGATCACCTGGCCAAAGGC (SEQ ID NO: 605): mut target(-10 +10):
TGAGATCACCAGGCCAAAGGC (SEQ ID NO: 606): [Model Cell line information]: cell: NCIH1573:
cancer type: LUNG: PAM dist: 16: indel length: 0: CRISPR gRNA ID: GF-CCELg9-543: [crRNA sequence]:
crRNA sequence: TGCCTCTATCGCCTTTGGCCTGG (SEQ ID NO: 2217):
SpgRNA: attctaatacgactcactataggTGCCTCTATCGCCTTTGGCCgttttagagctagaaatagcaagttaaaataaggctagtccgtta
tcaacttgaaaaagtggcaccgagtcggtgc (SEQ ID NO: 2218): [Target gene information]: Gene ID: 4595: Symbol:
MUTYH: Ensembl Transcript ID: EN5T00000372098.3: GRCh: 37: Chr: 1: [Target cancer mutation
information]: mut start: 45798247: mut end: 45798247: mut class: Splice Site: mut type: SNP: ref seq: T:
mut seq: A: mut aa: p.Q227L: mutation info source: CCLE: ref target(-10 +10):
TGAGATCACCTGGCCAAAGGC (SEQ ID NO: 605): mut target(-10 +10):
TGAGATCACCAGGCCAAAGGC (SEQ ID NO: 606): [Model Cell line information]: cell: NCIH1573:
cancer type: LUNG: PAM dist: 0: indel length: 0: CRISPR gRNA ID: GF-CCELg9-544: [crRNA sequence]:
crRNA sequence: TGTTGATCTGTCAGGACAGCAGG (SEQ ID NO: 2219):

TABLE 7-continued

Illustrative guide RNA sequences for polypeptides comprising Cas9

```
SpgRNA: attctaatacgactcactataggTGTTGATCTGTCAGGACAGCg0itagagctagaaatagcaagttaaaataaggctagtccgtt
atcaacttgaaaaagtggcaccgagtcggtgc (SEQ ID NO: 2220): [Target gene information]: Gene ID: 4683: Symbol:
NBN: Ensembl Transcript ID: EN5T00000265433.3: GRCh: 37: Chr: 8: [Target cancer mutation
information]: mut start: 90983459: mut end: 90983459: mut class: Missense Mutation: mut type: SNP: ref
seq: C: mut seq: T: mut aa: p.R215Q: mutation info source: CCLE: ref target(-10 +10):
TCTTTCCTGCCGTCCTGACAG (SEQ ID NO: 609): mut target(-10 +10):
TCTTTCCTGCTGTCCTGACAG (SEQ ID NO: 610): [Model Cell line information]: cell: NCIH1437:
cancer type: LUNG: PAM dist: 3: indel length: 0: CRISPR gRNA ID: GF-CCELg9-545: [crRNA sequence]:
crRNA sequence: GTGGGCTCAAGCTCAACAGCAGG (SEQ ID NO: 2221):
SpgRNA: attctaatacgactcactataggGTGGGCTCAAGCTCAACAGCg0itagagctagaaatagcaagttaaaataaggctagtccgtt
atcaacttgaaaaagtggcaccgagtcggtgc (SEQ ID NO: 2222): [Target gene information]: Gene ID: 9611: Symbol:
NCOR1: Ensembl Transcript ID: EN5T00000268712.3: GRCh: 37: Chr: 17: [Target cancer mutation
information]: mut start: 16005004: mut end: 16005004: mut class: Silent: mut type: SNP: ref seq: C: mut
seq: A: mut aa: p.A75 OA: mutation info source: CCLE: ref target(-10 +10):
CAAGCTCAACCGCAGGTTCTG (SEQ ID NO: 627): mut target(-10 +10):
CAAGCTCAACAGCAGGTTCTG (SEQ ID NO: 628): [Model Cell line information]: cell: NCIH1573:
cancer type: LUNG: PAM dist: 3: indel length: 0: CRISPR gRNA ID: GF-CCELg9-546: [crRNA sequence]:
crRNA sequence: TGTTGAGCTTGAGCCCACCACGG (SEQ ID NO: 2223):
SpgRNA: attctaatacgactcactataggTGTTGAGCTTGAGCCCACCACg0itagagctagaaatagcaagttaaaataaggctagtccgtt
atcaacttgaaaaagtggcaccgagtcggtgc (SEQ ID NO: 2224): [Target gene information]: Gene ID: 9611: Symbol:
NCOR1: Ensembl Transcript ID: EN5T00000268712.3: GRCh: 37: Chr: 17: [Target cancer mutation
information]: mut start: 16005004: mut end: 16005004: mut class: Silent: mut type: SNP: ref seq: C: mut
seq: A: mut aa: p.A75 OA: mutation info source: CCLE: ref target(-10 +10):
CAAGCTCAACCGCAGGTTCTG (SEQ ID NO: 627): mut target(-10 +10):
CAAGCTCAACAGCAGGTTCTG (SEQ ID NO: 628): [Model Cell line information]: cell: NCIH1573:
cancer type: LUNG: PAM dist: 20: indel length: 0: CRISPR gRNA ID: GF-CCELg9-547: [crRNA sequence]:
crRNA sequence: CTGCTCACAGGCAAGGTGTAAGG (SEQ ID NO: 2225):
SpgRNA: attctaatacgactcactataggCTGCTCACAGGCAAGGTGTAg0itagagctagaaatagcaagttaaaataaggctagtccgtt
337
atcaacttgaaaaagtggcaccgagtcggtgc (SEQ ID NO: 2226): [Target gene information]: Gene ID: 4792: Symbol:
NFKBIA: Ensembl Transcript ID: EN5T00000216797.5: GRCh: 37: Chr: 14: [Target cancer mutation
information]: mut start: 35872461: mut end: 35872461: mut class: Silent: mut type: SNP: ref seq: G: mut
seq: A: mut aa: p.L148L: mutation info source: CCLE: ref target(-10 +10):
GCAAGGTGTAGGGGGGTATTT (SEQ ID NO: 631): mut target(-10 +10):
GCAAGGTGTAAGGGGGTATTT (SEQ ID NO: 632): [Model Cell line information]: cell: CFPAC1:
cancer type: PANCREAS: PAM dist: 0: indel length: 0: CRISPR gRNA ID: GF-CCELg9-548: [crRNA
sequence]: crRNA sequence: TGCTCACAGGCAAGGTGTAAGGG (SEQ ID NO: 2227):
SpgRNA: attctaatacgactcactataggTGCTCACAGGCAAGGTGTAAgttttagagctagaaatagcaagttaaaataaggctagtccgtt
atcaacttgaaaaagtggcaccgagtcggtgc (SEQ ID NO: 2228): [Target gene information]: Gene ID: 4792: Symbol:
NFKBIA: Ensembl Transcript ID: EN5T00000216797.5: GRCh: 37: Chr: 14: [Target cancer mutation
information]: mut start: 35872461: mut end: 35872461: mut class: Silent: mut type: SNP: ref seq: G: mut
seq: A: mut aa: p.L148L: mutation info source: CCLE: ref target(-10 +10):
GCAAGGTGTAGGGGGGTATTT (SEQ ID NO: 631): mut target(-10 +10):
GCAAGGTGTAAGGGGGTATTT (SEQ ID NO: 632): [Model Cell line information]: cell: CFPAC1:
cancer type: PANCREAS: PAM dist: 1: indel length: 0: CRISPR gRNA ID: GF-CCELg9-549: [crRNA
sequence]: crRNA sequence: GCTCACAGGCAAGGTGTAAGGGG (SEQ ID NO: 2229):
SpgRNA: attctaatacgactcactataggGCTCACAGGCAAGGTGTAAGgttttagagctagaaatagcaagttaaaataaggctagtccgt
tatcaacttgaaaaagtggcaccgagtcggtgc (SEQ ID NO: 2230): [Target gene information]: Gene ID: 4792: Symbol:
NFKBIA: Ensembl Transcript ID: EN5T00000216797.5: GRCh: 37: Chr: 14: [Target cancer mutation
information]: mut start: 35872461: mut end: 35872461: mut class: Silent: mut type: SNP: ref seq: G: mut
seq: A: mut aa: p.L148L: mutation info source: CCLE: ref target(-10 +10):
GCAAGGTGTAGGGGGGTATTT (SEQ ID NO: 631): mut target(-10 +10):
GCAAGGTGTAAGGGGGTATTT (SEQ ID NO: 632): [Model Cell line information]: cell: CFPAC1:
cancer type: PANCREAS: PAM dist: 2: indel length: 0: CRISPR gRNA ID: GF-CCELg9-550: [crRNA
sequence]: crRNA sequence: CTCACAGGCAAGGTGTAAGGGGG (SEQ ID NO: 2231):
SpgRNA: attctaatacgactcactataggCTCACAGGCAAGGTGTAAGGgttttagagctagaaatagcaagttaaaataaggctagtccgt
tatcaacttgaaaaagtggcaccgagtcggtgc (SEQ ID NO: 2232): [Target gene information]: Gene ID: 4792: Symbol:
NFKBIA: Ensembl Transcript ID: EN5T00000216797.5: GRCh: 37: Chr: 14: [Target cancer mutation
information]: mut start: 35872461: mut end: 35872461: mut class: Silent: mut type: SNP: ref seq: G: mut
seq: A: mut aa: p.L148L: mutation info source: CCLE: ref target(-10 +10):
GCAAGGTGTAGGGGGGTATTT (SEQ ID NO: 631): mut target(-10 +10):
GCAAGGTGTAAGGGGGTATTT (SEQ ID NO: 632): [Model Cell line information]: cell: CFPAC1:
cancer type: PANCREAS: PAM dist: 3: indel length: 0: CRISPR gRNA ID: GF-CCELg9-551: [crRNA
sequence]: crRNA sequence: CTTACACCTTGCCTGTGAGCAGG (SEQ ID NO: 2233):
SpgRNA: attctaatacgactcactataggCTTACACCTTGCCTGTGAGCgttttagagctagaaatagcaagttaaaataaggctagtccgtt
atcaacttgaaaaagtggcaccgagtcggtgc (SEQ ID NO: 223 4): [Target gene information]: Gene ID: 4792: Symbol:
NFKBIA: Ensembl Transcript ID: EN5T00000216797.5: GRCh: 37: Chr: 14: [Target cancer mutation
information]: mut start: 35872461: mut end: 35872461: mut class: Silent: mut type: SNP: ref seq: G: mut
seq: A: mut aa: p.L148L: mutation info source: CCLE: ref target(-10 +10):
GCAAGGTGTAGGGGGGTATTT (SEQ ID NO: 631): mut target(-10 +10):
GCAAGGTGTAAGGGGGTATTT (SEQ ID NO: 632): [Model Cell line information]: cell: CFPAC1:
cancer type: PANCREAS: PAM dist: 19: indel length: 0: CRISPR gRNA ID: GF-CCELg9-552: [crRNA
sequence]: crRNA sequence: TTACACCTTGCCTGTGAGCAGG (SEQ ID NO: 2235):
SpgRNA: attctaatacgactcactataggTTACACCTTGCCTGTGAGCAgttttagagctagaaatagcaagttaaaataaggctagtccgtt
atcaacttgaaaaagtggcaccgagtcggtgc (SEQ ID NO: 223 6): [Target gene information]: Gene ID: 4792: Symbol:
NFKBIA: Ensembl Transcript ID: EN5T00000216797.5: GRCh: 37: Chr: 14: [Target cancer mutation
information]: mut start: 35872461: mut end: 35872461: mut class: Silent: mut type: SNP: ref seq: G: mut
seq: A: mut aa: p.L148L: mutation info source: CCLE: ref target(-10 +10):
```

TABLE 7-continued

Illustrative guide RNA sequences for polypeptides comprising Cas9

GCAAGGTGTAGGGGGGTATTT (SEQ ID NO: 631): mut target(-10 +10):
GCAAGGTGTAAGGGGGTATTT (SEQ ID NO: 632): [Model Cell line information]: cell: CFPAC1:
cancer type: PANCREAS: PAM dist: 20: indel length: 0: CRISPR gRNA ID: GF-CCELg9-553: [crRNA
sequence]: crRNA sequence: CGTCGTGCCATCATGCATGCAGG (SEQ ID NO: 2237):
SpgRNA: attctaatacgactcactataggCGTCGTGCCATCATGCATGCgttttagagctagaaatagcaagttaaaataaggctagtccgtt
atcaacttgaaaaagtggcaccgagtcggtgc (SEQ ID NO: 2238): [Target gene information]: Gene ID: 4851: Symbol:
NOTCH1: Ensembl Transcript ID: EN5T00000277541.6: GRCh: 37: Chr: 9: [Target cancer mutation
information]: mut start: 139393675: mut end: 139393675: mut class: Missense Mutation: mut type: SNP: ref
seq: G: mut seq: A: mut aa: p.R1991C: mutation info source: CCLE: ref target(-10 +10):
TCATGCATGCGGGCATCCAGG (SEQ ID NO: 2239): mut target(-10 +10):
TCATGCATGCAGGCATCCAGG (SEQ ID NO: 2240): [Model Cell line information]: cell: HCC827GR5:
cancer type: LUNG: PAM dist: 0: indel length: 0: CRISPR gRNA ID: GF-CCELg9-554: [crRNA sequence]:
crRNA sequence: CATCATGCATGCAGGCATCCAGG (SEQ ID NO: 2241):
SpgRNA: attctaatacgactcactataggCATCATGCATGCAGGCATCCgttttagagctagaaatagcaagttaaaataaggctagtccgtt
atcaacttgaaaaagtggcaccgagtcggtgc (SEQ ID NO: 2242): [Target gene information]: Gene ID: 4851: Symbol:
NOTCH1: Ensembl Transcript ID: EN5T00000277541.6: GRCh: 37: Chr: 9: [Target cancer mutation
information]: mut start: 139393675: mut end: 139393675: mut class: Missense Mutation: mut type: SNP: ref
seq: G: mut seq: A: mut aa: p.R1991C: mutation info source: CCLE: ref target(-10 +10):
TCATGCATGCGGGCATCCAGG (SEQ ID NO: 2239): mut target(-10 +10):
TCATGCATGCAGGCATCCAGG (SEQ ID NO: 2240): [Model Cell line information]: cell: HCC827GR5:
cancer type: LUNG: PAM dist: 8: indel length: 0: CRISPR gRNA ID: GF-CCELg9-555: [crRNA sequence]:
crRNA sequence: CATGCAGGCATCCAGGTCTGTGG (SEQ ID NO: 2243):
SpgRNA: attctaatacgactcactataggCATGCAGGCATCCAGGTCTGTGGCTgttttagagctagaaatagcaagttaaaataaggctagtccgtt
atcaacttgaaaaagtggcaccgagtcggtgc (SEQ ID NO: 2244): [Target gene information]: Gene ID: 4851: Symbol:
NOTCH1: Ensembl Transcript ID: EN5T00000277541.6: GRCh: 37: Chr: 9: [Target cancer mutation
information]: mut start: 139393675: mut end: 139393675: mut class: Missense Mutation: mut type: SNP: ref
seq: G: mut seq: A: mut aa: p.R1991C: mutation info source: CCLE: ref target(-10 +10):
TCATGCATGCGGGCATCCAGG (SEQ ID NO: 2239): mut target(-10 +10):
TCATGCATGCAGGCATCCAGG (SEQ ID NO: 2240): [Model Cell line information]: cell: HCC827GR5:
cancer type: LUNG: PAM dist: 15: indel length: 0: CRISPR gRNA ID: GF-CCELg9-556: [crRNA sequence]:
crRNA sequence: AGGCATCCAGGTCTGTGGCTCGG (SEQ ID NO: 2245):
SpgRNA: attctaatacgactcactataggAGGCATCCAGGTCTGTGGCTgttttagagctagaaatagcaagttaaaataaggctagtccgtt
atcaacttgaaaaagtggcaccgagtcggtgc (SEQ ID NO: 2246): [Target gene information]: Gene ID: 4851: Symbol:
NOTCH1: Ensembl Transcript ID: EN5T00000277541.6: GRCh: 37: Chr: 9: [Target cancer mutation
information]: mut start: 139393675: mut end: 139393675: mut class: Missense Mutation: mut type: SNP: ref
seq: G: mut seq: A: mut aa: p.R1991C: mutation info source: CCLE: ref target(-10 +10):
TCATGCATGCGGGCATCCAGG (SEQ ID NO: 2239): mut target(-10 +10):
TCATGCATGCAGGCATCCAGG (SEQ ID NO: 2240): [Model Cell line information]: cell: HCC827GR5:
cancer type: LUNG: PAM dist: 20: indel length: 0: CRISPR gRNA ID: GF-CCELg9-557: [crRNA sequence]:
crRNA sequence: CTGGATGCCTGCATGCATGATGG (SEQ ID NO: 2247):
SpgRNA: attctaatacgactcactataggCTGGATGCCTGCATGCATGAgttttagagctagaaatagcaagttaaaataaggctagtccgtt
atcaacttgaaaaagtggcaccgagtcggtgc (SEQ ID NO: 2248): [Target gene information]: Gene ID: 4851: Symbol:
NOTCH1: Ensembl Transcript ID: EN5T00000277541.6: GRCh: 37: Chr: 9: [Target cancer mutation
information]: mut start: 139393675: mut end: 139393675: mut class: Missense Mutation: mut type: SNP: ref
seq: G: mut seq: A: mut aa: p.R1991C: mutation info source: CCLE: ref target(-10 +10):
TCATGCATGCGGGCATCCAGG (SEQ ID NO: 2239): mut target(-10 +10):
TCATGCATGCAGGCATCCAGG (SEQ ID NO: 2240): [Model Cell line information]: cell: HCC827GR5:
cancer type: LUNG: PAM dist: 11: indel length: 0: CRISPR gRNA ID: GF-CCELg9-558: [crRNA sequence]:
crRNA sequence: CAGGTGCCGCCATGCAGGCAAGG (SEQ ID NO: 2249):
SpgRNA: attctaatacgactcactataggCAGGTGCCGCCATGCAGGCAgttttagagctagaaatagcaagttaaaataaggctagtccgt
tatcaacttgaaaaagtggcaccgagtcggtgc (SEQ ID NO: 2250): [Target gene information]: Gene ID: 4851: Symbol:
NOTCH1: Ensembl Transcript ID: ENST00000277541.6: GRCh: 37: Chr: 9: [Target cancer mutation
information]: mut start: 139403406: mut end: 139403406: mut class: Silent: mut type: SNP: ref seq: G: mut
seq: A: mut aa: p.P1029P: mutation info source: CCLE: ref target(-10 +10):
CATGCAGGCAGGGCTGTGAGT (SEQ ID NO: 2251): mut target(-10 +10):
CATGCAGGCAAGGCTGTGAGT (SEQ ID NO: 2252): [Model Cell line information]: cell: NCIH661:
cancer type: LUNG: PAM dist: 0: indel length: 0: CRISPR gRNA ID: GF-CCELg9-559: [crRNA sequence]:
crRNA sequence: GACTCACAGCCTTGCCTGCATGG (SEQ ID NO: 2253):
SpgRNA: attctaatacgactcactataggGACTCACAGCCTTGCCTGCAgttttagagctagaaatagcaagttaaaataaggctagtccgtt
atcaacttgaaaaagtggcaccgagtcggtgc (SEQ ID NO: 2254): [Target gene information]: Gene ID: 4851: Symbol:
NOTCH1: Ensembl Transcript ID: EN5T00000277541.6: GRCh: 37: Chr: 9: [Target cancer mutation
information]: mut start: 139403406: mut end: 139403406: mut class: Silent: mut type: SNP: ref seq: G: mut
seq: A: mut aa: p.P1029P: mutation info source: CCLE: ref target(-10 +10):
CATGCAGGCAGGGCTGTGAGT (SEQ ID NO: 2251): mut target(-10 +10):
CATGCAGGCAAGGCTGTGAGT (SEQ ID NO: 2252): [Model Cell line information]: cell: NCIH661:
cancer type: LUNG: PAM dist: 9: indel length: 0: CRISPR gRNA ID: GF-CCELg9-560: [crRNA sequence]:
crRNA sequence: TCACAGCCTTGCCTGCATGGCGG (SEQ ID NO: 2255):
SpgRNA: attctaatacgactcactataggTCACAGCCTTGCCTGCATGGgttttagagctagaaatagcaagttaaaataaggctagtccgtt
atcaacttgaaaaagtggcaccgagtcggtgc (SEQ ID NO: 2256): [Target gene information]: Gene ID: 4851: Symbol:
NOTCH1: Ensembl Transcript ID: EN5T00000277541.6: GRCh: 37: Chr: 9: [Target cancer mutation
information]: mut start: 139403406: mut end: 139403406: mut class: Silent: mut type: SNP: ref seq: G: mut
seq: A: mut aa: p.P1029P: mutation info source: CCLE: ref target(-10 +10):
CATGCAGGCAGGGCTGTGAGT (SEQ ID NO: 2251): mut target(-10 +10):
CATGCAGGCAAGGCTGTGAGT (SEQ ID NO: 2252): [Model Cell line information]: cell: NCIH661:
cancer type: LUNG: PAM dist: 12: indel length: 0: CRISPR gRNA ID: GF-CCELg9-561: [crRNA sequence]:
crRNA sequence: TCATTGGCCCGCCTCAGCCTCGG (SEQ ID NO: 2257):
SpgRNA: attctaatacgactcactataggTCATTGGCCCGCCTCAGCCTgttttagagctagaaatagcaagttaaaataaggctagtccgtt
atcaacttgaaaaagtggcaccgagtcggtgc (SEQ ID NO: 2258): [Target gene information]: Gene ID: 4854: Symbol:

TABLE 7-continued

Illustrative guide RNA sequences for polypeptides comprising Cas9

NOTCH3: Ensembl Transcript ID: EN5T00000263388.2: GRCh: 37: Chr: 19: [Target cancer mutation
information]: mut start: 15298691: mut end: 15298691: mut class: Splice Site: mut type: SNP: ref seq: C:
mut seq: G: mut aa: -: mutation info source: CCLE: ref target(-10 +10): GCCCGCCTCACCCTCGGCACA
(SEQ ID NO: 2259): mut target(-10 +10): GCCCGCCTCAGCCTCGGCACA (SEQ ID NO: 2260):
[Model Cell line information]: cell: NCIH661: cancer type: LUNG: PAM dist: 4: indel length: 0: CRISPR
gRNA ID: GF-CCELg9-562: [crRNA sequence]: crRNA sequence: CCGCCTCAGCCTCGGCACAGCGG
(SEQ ID NO: 2261):
SpgRNA: attctaatacgactcactataggCCGCCTCAGCCTCGGCACAGgttttagagctagaaatagcaagttaaaataaggctagtccgtt
atcaacttgaaaaagtggcaccgagtcggtgc (SEQ ID NO: 2262): [Target gene information]: Gene ID: 4854: Symbol:
NOTCH3: Ensembl Transcript ID: EN5T00000263388.2: GRCh: 37: Chr: 19: [Target cancer mutation
information]: mut start: 15298691: mut end: 15298691: mut class: Splice Site: mut type: SNP: ref seq: C:
mut seq: G: mut aa: -: mutation info source: CCLE: ref target(-10 +10): GCCCGCCTCACCCTCGGCACA
(SEQ ID NO: 2259): mut target(-10 +10): GCCCGCCTCAGCCTCGGCACA (SEQ ID NO: 2260):
[Model Cell line information]: cell: NCIH661: cancer type: LUNG: PAM dist: 12: indel length: 0: CRISPR
gRNA ID: GF-CCELg9-563: [crRNA sequence]: crRNA sequence: GTGCCGCTGTGCCGAGGCTGAGG
(SEQ ID NO: 2263):
SpgRNA: attctaatacgactcactataggGTGCCGCTGTGCCGAGGCTGgttttagagctagaaatagcaagttaaaataaggctagtccgtt
atcaacttgaaaaagtggcaccgagtcggtgc (SEQ ID NO: 2264): [Target gene information]: Gene ID: 4854: Symbol:
NOTCH3: Ensembl Transcript ID: EN5T00000263388.2: GRCh: 37: Chr: 19: [Target cancer mutation
information]: mut start: 15298691: mut end: 15298691: mut class: Splice Site: mut type: SNP: ref seq: C:
mut seq: G: mut aa: -: mutation info source: CCLE: ref target(-10 +10): GCCCGCCTCACCCTCGGCACA
(SEQ ID NO: 2259): mut target(-10 +10): GCCCGCCTCAGCCTCGGCACA (SEQ ID NO: 2260):
[Model Cell line information]: cell: NCIH661: cancer type: LUNG: PAM dist: 3: indel length: 0: CRISPR
gRNA ID: GF-CCELg9-564: [crRNA sequence]: crRNA sequence: CCGCTGTGCCGAGGCTGAGGCGG
(SEQ ID NO: 2265):
SpgRNA: attctaatacgactcactataggCCGCTGTGCCGAGGCTGAGGgttttagagctagaaatagcaagttaaaataaggctagtccgtt
atcaacttgaaaaagtggcaccgagtcggtgc (SEQ ID NO: 2266): [Target gene information]: Gene ID: 4854: Symbol:
NOTCH3: Ensembl Transcript ID: EN5T00000263388.2: GRCh: 37: Chr: 19: [Target cancer mutation
information]: mut start: 15298691: mut end: 15298691: mut class: Splice Site: mut type: SNP: ref seq: C:
mut seq: G: mut aa: -: mutation info source: CCLE: ref target(-10 +10): GCCCGCCTCACCCTCGGCACA
(SEQ ID NO: 2259): mut target(-10 +10): GCCCGCCTCAGCCTCGGCACA (SEQ ID NO: 2260):
[Model Cell line information]: cell: NCIH661: cancer type: LUNG: PAM dist: 6: indel length: 0: CRISPR
gRNA ID: GF-CCELg9-565: [crRNA sequence]: crRNA sequence: CGCTGTGCCGAGGCTGAGGCGGG
(SEQ ID NO: 2267):
SpgRNA: attctaatacgactcactataggCGCTGTGCCGAGGCTGAGGCg agagctagaaatagcaagttaaaataaggctagtccgtt
atcaacttgaaaaagtggcaccgagtcggtgc (SEQ ID NO: 2268): [Target gene information]: Gene ID: 4854: Symbol:
NOTCH3: Ensembl Transcript ID: EN5T00000263388.2: GRCh: 37: Chr: 19: [Target cancer mutation
information]: mut start: 15298691: mut end: 15298691: mut class: Splice Site: mut type: SNP: ref seq: C:
mut seq: G: mut aa: -: mutation info source: CCLE: ref target(-10 +10): GCCCGCCTCACCCTCGGCACA
(SEQ ID NO: 2259): mut target(-10 +10): GCCCGCCTCAGCCTCGGCACA (SEQ ID NO: 2260):
[Model Cell line information]: cell: NCIH661: cancer type: LUNG: PAM dist: 7: indel length: 0: CRISPR
gRNA ID: GF-CCELg9-566: [crRNA sequence]: crRNA sequence: TCTGACCGTCAAACCCTAGCAGG
(SEQ ID NO: 2269):
SpgRNA: attctaatacgactcactataggTCTGACCGTCAAACCCTAGCgttttagagctagaaatagcaagttaaaataaggctagtccgtt
atcaacttgaaaaagtggcaccgagtcggtgc (SEQ ID NO: 2270): [Target gene information]: Gene ID: 4854: Symbol:
NOTCH3: Ensembl Transcript ID: EN5T00000263388.2: GRCh: 37: Chr: 19: [Target cancer mutation
information]: mut start: 15302671: mut end: 15302671: mut class: Missense Mutation: mut type: SNP: ref
seq: C: mut seq: G: mut aa: p.E229D: mutation info source: CCLE: ref target(-10 +10):
AATTCTGACCCTCAAACCCTA (SEQ ID NO: 635): mut target(-10 +10):
AATTCTGACCGTCAAACCCTA (SEQ ID NO: 636): [Model Cell line information]: cell: NCIH460:
cancer type: LUNG: PAM dist: 13: indel length: 0: CRISPR gRNA ID: GF-CCELg9-567: [crRNA sequence]:
crRNA sequence: CCGTCAAACCCTAGCAGGGAAGG (SEQ ID NO: 2271):
SpgRNA: attctaatacgactcactataggCCGTCAAACCCTAGCAGGGAgttttagagctagaaatagcaagttaaaataaggctagtccgt
tatcaacttgaaaaagtggcaccgagtcggtgc (SEQ ID NO: 2272): [Target gene information]: Gene ID: 4854: Symbol:
NOTCH3: Ensembl Transcript ID: EN5T00000263388.2: GRCh: 37: Chr: 19: [Target cancer mutation
information]: mut start: 15302671: mut end: 15302671: mut class: Missense Mutation: mut type: SNP: ref
seq: C: mut seq: G: mut aa: p.E229D: mutation info source: CCLE: ref target(-10 +10):
AATTCTGACCCTCAAACCCTA (SEQ ID NO: 635): mut target(-10 +10):
AATTCTGACCGTCAAACCCTA (SEQ ID NO: 636): [Model Cell line information]: cell: NCIH460:
cancer type: LUNG: PAM dist: 18: indel length: 0: CRISPR gRNA ID: GF-CCELg9-568: [crRNA sequence]
crRNA sequence: CTGACCGTCAAACCCTAGCAGGG (SEQ ID NO: 2273):
SpgRNA: attctaatacgactcactataggCTGACCGTCAAACCCTAGCAgttttagagctagaaatagcaagttaaaataaggctagtccgtt
atcaacttgaaaaagtggcaccgagtcggtgc (SEQ ID NO: 2274): [Target gene information]: Gene ID: 4854: Symbol:
NOTCH3: Ensembl Transcript ID: EN5T00000263388.2: GRCh: 37: Chr: 19: [Target cancer mutation
information]: mut start: 15302671: mut end: 15302671: mut class: Missense Mutation: mut type: SNP: ref
seq: C: mut seq: G: mut aa: p.E229D: mutation info source: CCLE: ref target(-10 +10):
AATTCTGACCCTCAAACCCTA (SEQ ID NO: 635): mut target(-10 +10):
AATTCTGACCGTCAAACCCTA (SEQ ID NO: 636): [Model Cell line information]: cell: NCIH460:
cancer type: LUNG: PAM dist: 14: indel length: 0: CRISPR gRNA ID: GF-CCELg9-569: [crRNA sequence]:
crRNA sequence: CGTCAAACCCTAGCAGGGAAGGG (SEQ ID NO: 2275):
SpgRNA: attctaatacgactcactataggCGTCAAACCCTAGCAGGGAAgttttagagctagaaatagcaagttaaaataaggctagtccgt
tatcaacttgaaaaagtggcaccgagtcggtgc (SEQ ID NO: 2276): [Target gene information]: Gene ID: 4854: Symbol:
NOTCH3: Ensembl Transcript ID: ENST00000263388.2: GRCh: 37: Chr: 19: [Target cancer mutation
information]: mut start: 15302671: mut end: 15302671: mut class: Missense Mutation: mut type: SNP: ref
seq: C: mut seq: G: mut aa: p.E229D: mutation info source: CCLE: ref target(-10 +10):
AATTCTGACCCTCAAACCCTA (SEQ ID NO: 635): mut target(-10 +10):
AATTCTGACCGTCAAACCCTA (SEQ ID NO: 636): [Model Cell line information]: cell: NCIH460:
cancer type: LUNG: PAM dist: 19: indel length: 0: CRISPR gRNA ID: GF-CCELg9-570: [crRNA sequence]:

TABLE 7-continued

Illustrative guide RNA sequences for polypeptides comprising Cas9 crRNA sequence: GTCAAACCCTAGCAGGGAAGGGG (SEQ ID NO: 2277):
SpgRNA: attctaatacgactcactataggGTCAAACCCTAGCAGGGAAGGgttttagagctagaaatagcaagttaaaataaggctagtccgt
tatcaacttgaaaaagtggcaccgagtcggtgc (SEQ ID NO: 2278): [Target gene information]: Gene ID: 4854: Symbol:
NOTCH3: Ensembl Transcript ID: EN5T00000263388.2: GRCh: 37: Chr: 19: [Target cancer mutation
information]: mut start: 15302671: mut end: 15302671: mut class: Missense Mutation: mut type: SNP: ref
seq: C: mut seq: G: mut aa: p.E229D: mutation info source: CCLE: ref target(-10 +10):
AATTCTGACCCTCAAACCCTA (SEQ ID NO: 635): mut target(-10 +10):
AATTCTGACCGTCAAACCCTA (SEQ ID NO: 636): [Model Cell line information]: cell: NCIH460:
cancer type: LUNG: PAM dist: 20: indel length: 0: CRISPR gRNA ID: GF-CCELg9-571: [crRNA sequence]:
crRNA sequence: CCTTCCCTGCTAGGGTTTGACGG (SEQ ID NO: 2279):
SpgRNA: attctaatacgactcactataggCCTTCCCTGCTAGGGTTTGAgttttagagctagaaatagcaagttaaaataaggctagtccgtta
tcaacttgaaaaagtggcaccgagtcggtgc (SEQ ID NO: 2280): [Target gene information]: Gene ID: 4854: Symbol:
NOTCH3: Ensembl Transcript ID: EN5T00000263388.2: GRCh: 37: Chr: 19: [Target cancer mutation
information]: mut start: 15302671: mut end: 15302671: mut class: Missense Mutation: mut type: SNP: ref
seq: C: mut seq: G: mut aa: p.E229D: mutation info source: CCLE: ref target(-10 +10):
AATTCTGACCCTCAAACCCTA (SEQ ID NO: 635): mut target(-10 +10):
AATTCTGACCGTCAAACCCTA (SEQ ID NO: 636): [Model Cell line information]: cell: NCIH460:
cancer type: LUNG: PAM dist: 0: indel length: 0: CRISPR gRNA ID: GF-CCELg9-572: [crRNA sequence]:
crRNA sequence: AGGCAGATGCAGCGGAAGCCAGG (SEQ ID NO: 2281):
SpgRNA: attctaatacgactcactataggAGGCAGATGCAGCGGAAGCCgttttagagctagaaatagcaagttaaaataaggctagtccgt
tatcaacttgaaaaagtggcaccgagtcggtgc (SEQ ID NO: 2282): [Target gene information]: Gene ID: 4854: Symbol:
NOTCH3: Ensembl Transcript ID: EN5T00000263388.2: GRCh: 37: Chr: 19: [Target cancer mutation
information]: mut start: 15291806: mut end: 15291806: mut class: Missense Mutation: mut type: SNP: ref
seq: G: mut seq: A: mut aa: p.T987I: mutation info source: CCLE: ref target(-10 +10):
CTCGAGGCAGGTGCAGCGGAA (SEQ ID NO: 2283): mut target(-10 +10):
CTCGAGGCAGATGCAGCGGAA (SEQ ID NO: 2284): [Model Cell line information]: cell: SW1990:
cancer type: PANCREAS: PAM dist: 14: indel length: 0: CRISPR gRNA ID: GF-CCELg9-573: [crRNA
sequence]: crRNA sequence: AGATGCAGCGGAAGCCAGGGTGG (SEQ ID NO: 2285):
SpgRNA: attctaatacgactcactataggAGATGCAGCGGAAGCCAGGGgttttagagctagaaatagcaagttaaaataaggctagtccg
ttatcaacttgaaaaagtggcaccgagtcggtgc (SEQ ID NO: 2286): [Target gene information]: Gene ID: 4854:
Symbol: NOTCH3: Ensembl Transcript ID: EN5T00000263388.2: GRCh: 37: Chr: 19: [Target cancer
mutation information]: mut start: 15291806: mut end: 15291806: mut class: Missense Mutation: mut type:
SNP: ref seq: G: mut seq: A: mut aa: p.T987I: mutation info source: CCLE: ref target(-10 +10):
CTCGAGGCAGGTGCAGCGGAA (SEQ ID NO: 2283): mut target(-10 +10):
CTCGAGGCAGATGCAGCGGAA (SEQ ID NO: 2284): [Model Cell line information]: cell: SW1990:
cancer type: PANCREAS: PAM dist: 18: indel length: 0: CRISPR gRNA ID: GF-CCELg9-574: [crRNA
sequence]: crRNA sequence: AGCTCTCGAGGCAGATGCAGCGG (SEQ ID NO: 2287):
SpgRNA: attctaatacgactcactataggAGCTCTCGAGGCAGATGCAGgttttagagctagaaatagcaagttaaaataaggctagtccgt
tatcaacttgaaaaagtggcaccgagtcggtgc (SEQ ID NO: 2288): [Target gene information]: Gene ID: 4854: Symbol:
NOTCH3: Ensembl Transcript ID: EN5T00000263388.2: GRCh: 37: Chr: 19: [Target cancer mutation
information]: mut start: 15291806: mut end: 15291806: mut class: Missense Mutation: mut type: SNP: ref
seq: G: mut seq: A: mut aa: p.T987I: mutation info source: CCLE: ref target(-10 +10):
CTCGAGGCAGGTGCAGCGGAA (SEQ ID NO: 2283): mut target(-10 +10):
CTCGAGGCAGATGCAGCGGAA (SEQ ID NO: 2284): [Model Cell line information]: cell: SW1990:
cancer type: PANCREAS: PAM dist: 6: indel length: 0: CRISPR gRNA ID: GF-CCELg9-575: [crRNA
sequence]: crRNA sequence: GGCAGATGCAGCGGAAGCCAGG (SEQ ID NO: 2289):
SpgRNA: attctaatacgactcactataggGGCAGATGCAGCGGAAGCCAgttttagagctagaaatagcaagttaaaataaggctagtccgt
tatcaacttgaaaaagtggcaccgagtcggtgc (SEQ ID NO: 2290): [Target gene information]: Gene ID: 4854: Symbol:
NOTCH3: Ensembl Transcript ID: EN5T00000263388.2: GRCh: 37: Chr: 19: [Target cancer mutation
information]: mut start: 15291806: mut end: 15291806: mut class: Missense Mutation: mut type: SNP: ref
seq: G: mut seq: A: mut aa: p.T987I: mutation info source: CCLE: ref target(-10 +10):
CTCGAGGCAGGTGCAGCGGAA (SEQ ID NO: 2283): mut target(-10 +10):
CTCGAGGCAGATGCAGCGGAA (SEQ ID NO: 2284): [Model Cell line information]: cell: SW1990:
cancer type: PANCREAS: PAM dist: 15: indel length: 0: CRISPR gRNA ID: GF-CCELg9-576: [crRNA
sequence]: crRNA sequence: GATGCAGCGGAAGCCAGGGTGG (SEQ ID NO: 2291):
SpgRNA: attctaatacgactcactataggGATGCAGCGGAAGCCAGGGTgttttagagctagaaatagcaagttaaaataaggctagtccgt
tatcaacttgaaaaagtggcaccgagtcggtgc (SEQ ID NO: 2292): [Target gene information]: Gene ID: 4854: Symbol:
NOTCH3: Ensembl Transcript ID: EN5T00000263388.2: GRCh: 37: Chr: 19: [Target cancer mutation
information]: mut start: 15291806: mut end: 15291806: mut class: Missense Mutation: mut type: SNP: ref
seq: G: mut seq: A: mut aa: p.T987I: mutation info source: CCLE: ref target(-10 +10):
CTCGAGGCAGGTGCAGCGGAA (SEQ ID NO: 2283): mut target(-10 +10):
CTCGAGGCAGATGCAGCGGAA (SEQ ID NO: 2284): [Model Cell line information]: cell: SW1990:
cancer type: PANCREAS: PAM dist: 19: indel length: 0: CRISPR gRNA ID: GF-CCELg9-577: [crRNA
sequence]: crRNA sequence: CATCTGCCTCGAGAGCTTCACGG (SEQ ID NO: 2293):
SpgRNA: attctaatacgactcactataggCATCTGCCTCGAGAGCTTCACggttttagagctagaaatagcaagttaaaataaggctagtccgtt
atcaacttgaaaaagtggcaccgagtcggtgc (SEQ ID NO: 2294): [Target gene information]: Gene ID: 4854: Symbol:
NOTCH3: Ensembl Transcript ID: EN5T00000263388.2: GRCh: 37: Chr: 19: [Target cancer mutation
information]: mut start: 15291806: mut end: 15291806: mut class: Missense Mutation: mut type: SNP: ref
seq: G: mut seq: A: mut aa: p.T987I: mutation info source: CCLE: ref target(-10 +10):
CTCGAGGCAGGTGCAGCGGAA (SEQ ID NO: 2283): mut target(-10 +10):
CTCGAGGCAGATGCAGCGGAA (SEQ ID NO: 2284): [Model Cell line information]: cell: SW1990:
cancer type: PANCREAS: PAM dist: 18: indel length: 0: CRISPR gRNA ID: GF-CCELg9-578: [crRNA
sequence]: crRNA sequence: ATCTGCCTCGAGAGCTTCACGGG (SEQ ID NO: 2295):
SpgRNA: attctaatacgactcactataggATCTGCCTCGAGAGCTTCACgttttagagctagaaatagcaagttaaaataaggctagtccgtt
atcaacttgaaaaagtggcaccgagtcggtgc (SEQ ID NO: 2296): [Target gene information]: Gene ID: 4854: Symbol:
NOTCH3: Ensembl Transcript ID: EN5T00000263388.2: GRCh: 37: Chr: 19: [Target cancer mutation
information]: mut start: 15291806: mut end: 15291806: mut class: Missense Mutation: mut type: SNP: ref
seq: G: mut seq: A: mut aa: p.T987I: mutation info source: CCLE: ref target(-10 +10):

TABLE 7-continued

Illustrative guide RNA sequences for polypeptides comprising Cas9

CTCGAGGCAGGTGCAGCGGAA (SEQ ID NO: 2283): mut target(-10 +10):
CTCGAGGCAGATGCAGCGGAA (SEQ ID NO: 2284): [Model Cell line information]: cell: SW1990:
cancer type: PANCREAS: PAM dist: 19: indel length: 0: CRISPR gRNA ID: GF-CCELg9-579: [crRNA
sequence]: crRNA sequence: CCACTGCAGCCATGGCAGCAAGG (SEQ ID NO: 2297):
SpgRNA: attctaatacgactcactataggCCACTGCAGCCATGGCAGCAg ttttagagctagaaatagcaagttaaaataaggctagtccgtt
atcaacttgaaaaagtggcaccgagtcggtgc (SEQ ID NO: 2298): [Target gene information]: Gene ID: 4855: Symbol:
NOTCH4: Ensembl Transcript ID: EN5T00000375023.3: GRCh: 37: Chr: 6: [Target cancer mutation
information]: mut start: 32168681: mut end: 32168681: mut class: Silent: mut type: SNP: ref seq: C: mut
seq: G: mut aa: p.A1414A: mutation info source: CCLE: ref target(-10 +10):
CTGCAGCCATCGCAGCAAGGA (SEQ ID NO: 2299): mut target(-10 +10):
CTGCAGCCATGGCAGCAAGGA (SEQ ID NO: 2300): [Model Cell line information]: cell: NCIH1573:
cancer type: LUNG: PAM dist: 7: indel length: 0: CRISPR gRNA ID: GF-CCELg9-580: [crRNA sequence]:
crRNA sequence: CAGGGCTCCCACTGCAGCCATGG (SEQ ID NO: 2301):
SpgRNA: attctaatacgactcactataggCAGGGCTCCCACTGCAGCCAg ttttagagctagaaatagcaagttaaaataaggctagtccgtt
atcaacttgaaaaagtggcaccgagtcggtgc (SEQ ID NO: 2302): [Target gene information]: Gene ID: 4855: Symbol:
NOTCH4: Ensembl Transcript ID: EN5T00000375023.3: GRCh: 37: Chr: 6: [Target cancer mutation
information]: mut start: 32168681: mut end: 32168681: mut class: Silent: mut type: SNP: ref seq: C: mut
seq: G: mut aa: p.A1414A: mutation info source: CCLE: ref target(-10 +10):
CTGCAGCCATCGCAGCAAGGA (SEQ ID NO: 2299): mut target(-10 +10):
CTGCAGCCATGGCAGCAAGGA (SEQ ID NO: 2300): [Model Cell line information]: cell: NCIH1573:
cancer type: LUNG: PAM dist: -1: indel length: 0: CRISPR gRNA ID: GF-CCELg9-581: [crRNA sequence]:
crRNA sequence: CAGCCATGGCAGCAAGGAAGCGG (SEQ ID NO: 2303):
SpgRNA: attctaatacgactcactataggCAGCCATGGCAGCAAGGAAGCGg ttagagctagaaatagcaagttaaaataaggctagtccgt
tatcaacttgaaaaagtggcaccgagtcggtgc (SEQ ID NO: 2304): [Target gene information]: Gene ID: 4855: Symbol:
NOTCH4: Ensembl Transcript ID: EN5T00000375023.3: GRCh: 37: Chr: 6: [Target cancer mutation
information]: mut start: 32168681: mut end: 32168681: mut class: Silent: mut type: SNP: ref seq: C: mut
seq: G: mut aa: p.A1414A: mutation info source: CCLE: ref target(-10 +10):
CTGCAGCCATCGCAGCAAGGA (SEQ ID NO: 2299): mut target(-10 +10):
CTGCAGCCATGGCAGCAAGGA (SEQ ID NO: 2300): [Model Cell line information]: cell: NCIH1573:
cancer type: LUNG: PAM dist: 13: indel length: 0: CRISPR gRNA ID: GF-CCELg9-582: [crRNA sequence]:
crRNA sequence: ACTCCGCTTCCTTGCTGCCATGG (SEQ ID NO: 2305):
SpgRNA: attctaatacgactcactataggACTCCGCTTCCTTGCTGCCAgttttagagctagaaatagcaagttaaaataaggctagtccgtta
tcaacttgaaaaagtggcaccgagtcggtgc (SEQ ID NO: 2306): [Target gene information]: Gene ID: 4855: Symbol:
NOTCH4: Ensembl Transcript ID: EN5T00000375023.3: GRCh: 37: Chr: 6: [Target cancer mutation
information]: mut start: 32168681: mut end: 32168681: mut class: Silent: mut type: SNP: ref seq: C: mut
seq: G: mut aa: p.A1414A: mutation info source: CCLE: ref target(-10 +10):
CTGCAGCCATCGCAGCAAGGA (SEQ ID NO: 2299): mut target(-10 +10):
CTGCAGCCATGGCAGCAAGGA (SEQ ID NO: 2300): [Model Cell line information]: cell: NCIH1573:
cancer type: LUNG: PAM dist: 2: indel length: 0: CRISPR gRNA ID: GF-CCELg9-583: [crRNA sequence]:
crRNA sequence: CCTTGCTGCCATGGCTGCAGTGG (SEQ ID NO: 2307):
SpgRNA: attctaatacgactcactataggCCTTGCTGCCATGGCTGCAGgttttagagctagaaatagcaagttaaaataaggctagtccgtt
atcaacttgaaaaagtggcaccgagtcggtgc (SEQ ID NO: 2308): [Target gene information]: Gene ID: 4855: Symbol:
NOTCH4: Ensembl Transcript ID: EN5T00000375023.3: GRCh: 37: Chr: 6: [Target cancer mutation
information]: mut start: 32168681: mut end: 32168681: mut class: Silent: mut type: SNP: ref seq: C: mut
seq: G: mut aa: p.A1414A: mutation info source: CCLE: ref target(-10 +10):
CTGCAGCCATCGCAGCAAGGA (SEQ ID NO: 2299): mut target(-10 +10):
CTGCAGCCATGGCAGCAAGGA (SEO ID NO: 2300): [Model Cell line information]: cell: NCIH1573:
cancer type: LUNG: PAM dist: 11: indel length: 0: CRISPR gRNA ID: GF-CCELg9-584: [crRNA sequence]:
crRNA sequence: CATGGCTGCAGTGGGAGCCCTGG (SEQ ID NO: 2309):
SpgRNA: attctaatacgactcactataggCATGGCTGCAGTGGGAGCCCgttttagagctagaaatagcaagttaaaataaggctagtccgtt
atcaacttgaaaaagtggcaccgagtcggtgc (SEQ ID NO: 2310): [Target gene information]: Gene ID: 4855: Symbol:
NOTCH4: Ensembl Transcript ID: EN5T00000375023.3: GRCh: 37: Chr: 6: [Target cancer mutation
information]: mut start: 32168681: mut end: 32168681: mut class: Silent: mut type: SNP: ref seq: C: mut
seq: G: mut aa: p.A1414A: mutation info source: CCLE: ref target(-10 +10):
CTGCAGCCATCGCAGCAAGGA (SEQ ID NO: 2299): mut target(-10 +10):
CTGCAGCCATGGCAGCAAGGA (SEQ ID NO: 2300): [Model Cell line information]: cell: NCIH1573:
cancer type: LUNG: PAM dist: 20: indel length: 0: CRISPR gRNA ID: GF-CCELg9-585: [crRNA sequence]:
crRNA sequence: CTTGCTGCCATGGCTGCAGTGGG (SEQ ID NO: 2311):
SpgRNA: attctaatacgactcactataggCTTGCTGCCATGGCTGCAGTgttttagagctagaaatagcaagttaaaataaggctagtccgtt
atcaacttgaaaaagtggcaccgagtcggtgc (SEQ ID NO: 2312): [Target gene information]: Gene ID: 4855: Symbol:
NOTCH4: Ensembl Transcript ID: EN5T00000375023.3: GRCh: 37: Chr: 6: [Target cancer mutation
information]: mut start: 32168681: mut end: 32168681: mut class: Silent: mut type: SNP: ref seq: C: mut
seq: G: mut aa: p.A1414A: mutation info source: CCLE: ref target(-10 +10):
CTGCAGCCATCGCAGCAAGGA (SEQ ID NO: 2299): mut target(-10 +10):
CTGCAGCCATGGCAGCAAGGA (SEQ ID NO: 2300): [Model Cell line information]: cell: NCIH1573:
cancer type: LUNG: PAM dist: 12: indel length: 0: CRISPR gRNA ID: GF-CCELg9-586: [crRNA sequence]:
crRNA sequence: GGCATCCGAGAGTGCTCGGCAGG (SEQ ID NO: 2313):
SpgRNA: attctaatacgactcactataggGGCATCCGAGAGTGCTCGGCgttttagagctagaaatagcaagttaaaataaggctagtccgtt
atcaacttgaaaaagtggcaccgagtcggtgc (SEQ ID NO: 2314): [Target gene information]: Gene ID: 4914: Symbol:
NTRK1: Ensembl Transcript ID: EN5T00000524377.1: GRCh: 37: Chr: 1: [Target cancer mutation
information]: mut start: 156846206: mut end: 156846206: mut class: Silent: mut type: SNP: ref seq: G: mut
seq: A: mut aa: p.A549A: mutation info source: CCLE: ref target(-10 +10):
TGAAGGAGGGTCCGAGAGTG (SEQ ID NO: 2315): mut target(-10 +10):
TGAAGGAGGATCCGAGAGTG (SEQ ID NO: 2316): [Model Cell line information]: cell: KMBC2:
cancer type: -: PAM dist: 17: indel length: 0: CRISPR gRNA ID: GF-CCELg9-587: [crRNA sequence]:
crRNA sequence: AGGAGGATCCGAGAGTGCTCGG (SEQ ID NO: 2317):
SpgRNA: attctaatacgactcactataggAGGAGGCATCCGAGAGTGCTgttttagagctagaaatagcaagttaaaataaggctagtccgt
tatcaacttgaaaaagtggcaccgagtcggtgc (SEQ ID NO: 2318): [Target gene information]: Gene ID: 4914: Symbol:

TABLE 7-continued

Illustrative guide RNA sequences for polypeptides comprising Cas9

NTRK1: Ensembl Transcript ID: EN5T00000524377.1: GRCh: 37: Chr: 1: [Target cancer mutation
information]: mut start: 156846206: mut end: 156846206: mut class: Silent: mut type: SNP: ref seq: G: mut
seq: A: mut aa: p.A549A: mutation info source: CCLE: ref target(-10 +10):
TGAAGGAGGCGTCCGAGAGTG (SEQ ID NO: 2315): mut target(-10 +10):
TGAAGGAGGCATCCGAGAGTG (SEQ ID NO: 2316): [Model Cell line information]: cell: KMBC2:
cancer type: -: PAM dist: 13: indel length: 0: CRISPR gRNA ID: GF-CCELg9-588: [crRNA sequence]:
crRNA sequence: CGGATGCCTCCTTCAGTGCCTGG (SEQ ID NO: 2319):
SpgRNA: attctaatacgactcactataggCGGATGCCTCCTTCAGTGCCGttttagagctagaaatagcaagttaaaataaggctagtccgtt
atcaacttgaaaaagtggcaccgagtcggtgc (SEQ ID NO: 2320): [Target gene information]: Gene ID: 4914: Symbol:
NTRK1: Ensembl Transcript ID: EN5T00000524377.1: GRCh: 37: Chr: 1: [Target cancer mutation
information]: mut start: 156846206: mut end: 156846206: mut class: Silent: mut type: SNP: ref seq: G: mut
seq: A: mut aa: p.A549A: mutation info source: CCLE: ref target(-10 +10):
TGAAGGAGGCGTCCGAGAGTG (SEQ ID NO: 2315): mut target(-10 +10):
TGAAGGAGGCATCCGAGAGTG (SEQ ID NO: 2316): [Model Cell line information]: cell: KMBC2:
cancer type: -: PAM dist: 16: indel length: 0: CRISPR gRNA ID: GF-CCELg9-589: [crRNA sequence]:
crRNA sequence: TGCCTCCTTCAGTGCCTGGATGG (SEQ ID NO: 2321):
SpgRNA: attctaatacgactcactataggTGCCTCCTTCAGTGCCTGGAgttttagagctagaaatagcaagttaaaataaggctagtccgtt
atcaacttgaaaaagtggcaccgagtcggtgc (SEQ ID NO: 2322): [Target gene information]: Gene ID: 4914: Symbol:
NTRK1: Ensembl Transcript ID: EN5T00000524377.1: GRCh: 37: Chr: 1: [Target cancer mutation
information]: mut start: 156846206: mut end: 156846206: mut class: Silent: mut type: SNP: ref seq: G: mut
seq: A: mut aa: p.A549A: mutation info source: CCLE: ref target(-10 +10):
TGAAGGAGGCGTCCGAGAGTG (SEQ ID NO: 2315): mut target(-10 +10):
TGAAGGAGGCATCCGAGAGTG (SEQ ID NO: 2316): [Model Cell line information]: cell: KMBC2:
cancer type: -: PAM dist: 20: indel length: 0: CRISPR gRNA ID: GF-CCELg9-590: [crRNA sequence]:
crRNA sequence: TGCATTCCATTCACTGTGCAAGG (SEQ ID NO: 2323):
SpgRNA: attctaatacgactcactataggTGCATTCCATTCACTGTGAgttttagagctagaaatagcaagttaaaataaggctagtccgtta
tcaacttgaaaaagtggcaccgagtcggtgc (SEQ ID NO: 2324): [Target gene information]: Gene ID: 4915: Symbol:
NTRK2: Ensembl Transcript ID: ENST00000323115.4: GRCh: 37: Chr: 9: [Target cancer mutation
information]: mut start: 87342637: mut end: 87342637: mut class: Missense Mutation: mut type: SNP: ref
seq: A: mut seq: C: mut aa: p.K308Q: mutation info source: CCLE: ref target(-10 +10):
ATTCACTGTGAAAGGCAACCC (SEQ ID NO: 649): mut target(-10 +10):
ATTCACTGTGCAAGGCAACCC (SEQ ID NO: 650): [Model Cell line information]: cell: NCIH661:
cancer type: LUNG: PAM dist: 2: indel length: 0: CRISPR gRNA ID: GF-CCELg9-591: [crRNA sequence]:
crRNA sequence: GGGTTGCCTTGCACAGTGAATGG (SEQ ID NO: 2325):
SpgRNA: attctaatacgactcactataggGGGTTGCCTTGCACAGTGAAgttttagagctagaaatagcaagttaaaataaggctagtccgtt
atcaacttgaaaaagtggcaccgagtcggtgc (SEQ ID NO: 2326): [Target gene information]: Gene ID: 4915: Symbol:
NTRK2: Ensembl Transcript ID: ENST00000323115.4: GRCh: 37: Chr: 9: [Target cancer mutation
information]: mut start: 87342637: mut end: 87342637: mut class: Missense Mutation: mut type: SNP: ref
seq: A: mut seq: C: mut aa: p.K308Q: mutation info source: CCLE: ref target(-10 +10):
ATTCACTGTGAAAGGCAACCC (SEQ ID NO: 649): mut target(-10 +10):
ATTCACTGTGCAAGGCAACCC (SEQ ID NO: 650): [Model Cell line information]: cell: NCIH661:
cancer type: LUNG: PAM dist: 10: indel length: 0: CRISPR gRNA ID: GF-CCELg9-592: [crRNA sequence]:
3crRNA sequence: CAGACGTGGGGGATCTGTCAAGG (SEQ ID NO: 2327):
SpgRNA: attctaatacgactcactataggCAGACGTGGGGGATCTGTCgttttagagctagaaatagcaagttaaaataaggctagtccgtt
atcaacttgaaaaagtggcaccgagtcggtgc (SEQ ID NO: 2328): [Target gene information]: Gene ID: 4916: Symbol:
NTRK3: Ensembl Transcript ID: EN5T00000360948.2: GRCh: 37: Chr: 15: [Target cancer mutation
information]: mut start: 88678617: mut end: 88678617: mut class: Missense Mutation: mut type: SNP: ref
seq: C: mut seq: G: mut aa: p.V307L: mutation info source: CCLE: ref target(-10 +10):
AGGCTCACCACACGTGGGGGA (SEQ ID NO: 2329): mut target(-10 +10):
AGGCTCACCAGACGTGGGGGA (SEQ ID NO: 2330): [Model Cell line information]: cell: NCIH1437:
cancer type: LUNG: PAM dist: 18: indel length: 0: CRISPR gRNA ID: GF-CCELg9-593: [crRNA sequence]:
crRNA sequence: TCCTCCAGGCTCACCAGACGTGG (SEQ ID NO: 2331):
SpgRNA: attctaatacgactcactataggTCCTCCAGGCTCACCAGACGgttttagagctagaaatagcaagttaaaataaggctagtccgtt
atcaacttgaaaaagtggcaccgagtcggtgc (SEQ ID NO: 2332): [Target gene information]: Gene ID: 4916: Symbol:
NTRK3: Ensembl Transcript ID: EN5T00000360948.2: GRCh: 37: Chr: 15: [Target cancer mutation
information]: mut start: 88678617: mut end: 88678617: mut class: Missense Mutation: mut type: SNP: ref
seq: C: mut seq: G: mut aa: p.V307L: mutation info source: CCLE: ref target(-10 +10):
AGGCTCACCACACGTGGGGGA (SEQ ID NO: 2329): mut target(-10 +10):
AGGCTCACCAGACGTGGGGGA (SEQ ID NO: 2330): [Model Cell line information]: cell: NCIH1437:
cancer type: LUNG: PAM dist: 4: indel length: 0: CRISPR gRNA ID: GF-CCELg9-594: [crRNA sequence]:
crRNA sequence: CCTCCAGGCTCACCAGACGTGGG (SEQ ID NO: 2333):
SpgRNA: attctaatacgactcactataggCCTCCAGGCTCACCAGACGTgttttagagctagaaatagcaagttaaaataaggctagtccgtt
atcaacttgaaaaagtggcaccgagtcggtgc (SEQ ID NO: 2334): [Target gene information]: Gene ID: 4916: Symbol:
NTRK3: Ensembl Transcript ID: EN5T00000360948.2: GRCh: 37: Chr: 15: [Target cancer mutation
information]: mut start: 88678617: mut end: 88678617: mut class: Missense Mutation: mut type: SNP: ref
seq: C: mut seq: G: mut aa: p.V307L: mutation info source: CCLE: ref target(-10 +10):
AGGCTCACCACACGTGGGGGA (SEQ ID NO: 2329): mut target(-10 +10):
AGGCTCACCAGACGTGGGGGA (SEQ ID NO: 2330): [Model Cell line information]: cell: NCIH1437:
cancer type: LUNG: PAM dist: 5: indel length: 0: CRISPR gRNA ID: GF-CCELg9-595: [crRNA sequence]:
crRNA sequence: CTCCAGGCTCACCAGACGTGGGG (SEQ ID NO: 2335):
SpgRNA: attctaatacgactcactataggCTCCAGGCTCACCAGACGTGgttttagagctagaaatagcaagttaaaataaggctagtccgtt
atcaacttgaaaaagtggcaccgagtcggtgc (SEQ ID NO: 233 6): [Target gene information]: Gene ID: 4916: Symbol:
NTRK3: Ensembl Transcript ID: EN5T00000360948.2: GRCh: 37: Chr: 15: [Target cancer mutation
information]: mut start: 88678617: mut end: 88678617: mut class: Missense Mutation: mut type: SNP: ref
seq: C: mut seq: G: mut aa: p.V307L: mutation info source: CCLE: ref target(-10 +10):
AGGCTCACCACACGTGGGGGA (SEQ ID NO: 2329): mut target(-10 +10):
AGGCTCACCAGACGTGGGGGA (SEQ ID NO: 233 0): [Model Cell line information]: cell: NCIH1437:
cancer type: LUNG: PAM dist: 6: indel length: 0: CRISPR gRNA ID: GF-CCELg9-596: [crRNA sequence]:

TABLE 7-continued

Illustrative guide RNA sequences for polypeptides comprising Cas9 crRNA sequence: TCCAGGCTCACCAGACGTGGGGG (SEQ ID NO: 2337):
SpgRNA: attctaatacgactcactataggTCCAGGCTCACCAGACGTGGgttttagagctagaaatagcaagttaaaataaggctagtccgtt
atcaacttgaaaaagtggcaccgagtcggtgc (SEQ ID NO: 233 8): [Target gene information]: Gene ID: 4916: Symbol:
NTRK3: Ensembl Transcript ID: EN5T00000360948.2: GRCh: 37: Chr: 15: [Target cancer mutation
information]: mut start: 88678617: mut end: 88678617: mut class: Missense Mutation: mut type: SNP: ref
seq: C: mut seq: G: mut aa: p.V307L: mutation info source: CCLE: ref target(-10 +10):
AGGCTCACCACACGTGGGGGA (SEQ ID NO: 2329): mut target(-10 +10):
AGGCTCACCAGACGTGGGGGA (SEQ ID NO: 233 0): [Model Cell line information]: cell: NCIH1437:
cancer type: LUNG: PAM dist: 7: indel length: 0: CRISPR gRNA ID: GF-CCELg9-597: [crRNA sequence]:
crRNA sequence: AGACGTGGGGGATCTGTCAAGGG (SEQ ID NO: 2339):
SpgRNA: attctaatacgactcactataggAGACGTGGGGGATCTGTCAAgttttagagctagaaatagcaagttaaaataaggctagtccgt
tatcaacttgaaaaagtggcaccgagtcggtgc (SEQ ID NO: 234 0): [Target gene information]: Gene ID: 4916: Symbol:
NTRK3: Ensembl Transcript ID: EN5T00000360948.2: GRCh: 37: Chr: 15: [Target cancer mutation
information]: mut start: 88678617: mut end: 88678617: mut class: Missense Mutation: mut type: SNP: ref
seq: C: mut seq: G: mut aa: p.V307L: mutation info source: CCLE: ref target(-10 +10):
AGGCTCACCACACGTGGGGGA (SEQ ID NO: 2329): mut target(-10 +10):
AGGCTCACCAGACGTGGGGGA (SEQ ID NO: 233 0): [Model Cell line information]: cell: NCIH1437:
cancer type: LUNG: PAM dist: 19: indel length: 0: CRISPR gRNA ID: GF-CCELg9-598: [crRNA sequence]:
crRNA sequence: CCCACGTCTGGTGAGCCTGGAGG (SEQ ID NO: 2341):
SpgRNA: attctaatacgactcactataggCCCACGTCTGGTGAGCCTGGgttttagagctagaaatagcaagttaaaataaggctagtccgtt
atcaacttgaaaaagtggcaccgagtcggtgc (SEQ ID NO: 2342): [Target gene information]: Gene ID: 4916: Symbol:
NTRK3: Ensembl Transcript ID: EN5T00000360948.2: GRCh: 37: Chr: 15: [Target cancer mutation
information]: mut start: 88678617: mut end: 88678617: mut class: Missense Mutation: mut type: SNP: ref
seq: C: mut seq: G: mut aa: p.V307L: mutation info source: CCLE: ref target(-10 +10):
AGGCTCACCACACGTGGGGGA (SEQ ID NO: 2329): mut target(-10 +10):
AGGCTCACCAGACGTGGGGGA (SEQ ID NO: 2330): [Model Cell line information]: cell: NCIH1437:
cancer type: LUNG: PAM dist: 13: indel length: 0: CRISPR gRNA ID: GF-CCELg9-599: [crRNA sequence]:
crRNA sequence: CTTGACAGATCCCCCACGTCTGG (SEQ ID NO: 2343):
SpgRNA: attctaatacgactcactataggCTTGACAGATCCCCCACGTCgttttagagctagaaatagcaagttaaaataaggctagtccgtt
atcaacttgaaaaagtggcaccgagtcggtgc (SEQ ID NO: 2344): [Target gene information]: Gene ID: 4916: Symbol:
NTRK3: Ensembl Transcript ID: EN5T00000360948.2: GRCh: 37: Chr: 15: [Target cancer mutation
information]: mut start: 88678617: mut end: 88678617: mut class: Missense Mutation: mut type: SNP: ref
seq: C: mut seq: G: mut aa: p.V307L: mutation info source: CCLE: ref target(-10 +10):
AGGCTCACCACACGTGGGGGA (SEQ ID NO: 2329): mut target(-10 +10):
AGGCTCACCAGACGTGGGGGA (SEQ ID NO: 2330): [Model Cell line information]: cell: NCIH1437:
cancer type: LUNG: PAM dist: 1: indel length: 0: CRISPR gRNA ID: GF-CCELg9-600: [crRNA sequence]:
crRNA sequence: TCCCCCACGTCTGGTGAGCCTGG (SEQ ID NO: 2345):
SpgRNA: attctaatacgactcactataggTCCCCCACGTCTGGTGAGCCgttttagagctagaaatagcaagttaaaataaggctagtccgtt
atcaacttgaaaaagtggcaccgagtcggtgc (SEQ ID NO: 2346): [Target gene information]: Gene ID: 4916: Symbol:
NTRK3: Ensembl Transcript ID: EN5T00000360948.2: GRCh: 37: Chr: 15: [Target cancer mutation
information]: mut start: 88678617: mut end: 88678617: mut class: Missense Mutation: mut type: SNP: ref
seq: C: mut seq: G: mut aa: p.V307L: mutation info source: CCLE: ref target(-10 +10):
AGGCTCACCACACGTGGGGGA (SEQ ID NO: 2329): mut target(-10 +10):
AGGCTCACCAGACGTGGGGGA (SEQ ID NO: 2330): [Model Cell line information]: cell: NCIH1437:
cancer type: LUNG: PAM dist: 10: indel length: 0: CRISPR gRNA ID: GF-CCELg9-601: [crRNA sequence]:
crRNA sequence: GCCCTTCCAGGAGGCGGAAGAGG (SEQ ID NO: 2347):
SpgRNA: attctaatacgactcactataggGCCCTTCCAGGAGGCGGAAGgttttagagctagaaatagcaagttaaaataaggctagtccgt
tatcaacttgaaaaagtggcaccgagtcggtgc (SEQ ID NO: 2348): [Target gene information]: Gene ID: 4916: Symbol:
NTRK3: Ensembl Transcript ID: EN5T00000360948.2: GRCh: 37: Chr: 15: [Target cancer mutation
information]: mut start: 88799221: mut end: 88799221: mut class: Missense Mutation: mut type: SNP: ref
seq: G: mut seq: C: mut aa: p.P55R: mutation info source: CCLE: ref target(-10 +10):
TTCCAGGAGGGGGAAGAGGTT (SEQ ID NO: 2349): mut target(-10 +10):
TTCCAGGAGGCGGAAGAGGTT (SEQ ID NO: 2350): [Model Cell line information]: cell: NCIH1563:
cancer type: LUNG: PAM dist: 6: indel length: 0: CRISPR gRNA ID: GF-CCELg9-602: [crRNA sequence]:
crRNA sequence: AATCCTGCCCTTCCAGGAGGCGG (SEQ ID NO: 2351):
SpgRNA: attctaatacgactcactataggAATCCTGCCCTTCCAGGAGGgttttagagctagaaatagcaagttaaaataaggctagtccgtt
atcaacttgaaaaagtggcaccgagtcggtgc (SEQ ID NO: 2352): [Target gene information]: Gene ID: 4916: Symbol:
NTRK3: Ensembl Transcript ID: EN5T00000360948.2: GRCh: 37: Chr: 15: [Target cancer mutation
information]: mut start: 88799221: mut end: 88799221: mut class: Missense Mutation: mut type: SNP: ref
seq: G: mut seq: C: mut aa: p.P55R: mutation info source: CCLE: ref target(-10 +10):
TTCCAGGAGGGGGAAGAGGTT (SEQ ID NO: 2349): mut target(-10 +10):
TTCCAGGAGGCGGAAGAGGTT (SEQ ID NO: 2350): [Model Cell line information]: cell: NCIH1563:
cancer type: LUNG: PAM dist: 0: indel length: 0: CRISPR gRNA ID: GF-CCELg9-603: [crRNA sequence]:
crRNA sequence: CGGAAGAGGTTCCCATCGTCCGG (SEQ ID NO: 2353):
SpgRNA: attctaatacgactcactataggCGGAAGAGGTTCCCATCGTCgttttagagctagaaatagcaagttaaaataaggctagtccgtt
atcaacttgaaaaagtggcaccgagtcggtgc (SEQ ID NO: 2354): [Target gene information]: Gene ID: 4916: Symbol:
NTRK3: Ensembl Transcript ID: EN5T00000360948.2: GRCh: 37: Chr: 15: [Target cancer mutation
information]: mut start: 88799221: mut end: 88799221: mut class: Missense Mutation: mut type: SNP: ref
seq: G: mut seq: C: mut aa: p.P55R: mutation info source: CCLE: ref target(-10 +10):
TTCCAGGAGGGGGAAGAGGTT (SEQ ID NO: 2349): mut target(-10 +10):
TTCCAGGAGGCGGAAGAGGTT (SEQ ID NO: 2350): [Model Cell line information]: cell: NCIH1563:
cancer type: LUNG: PAM dist: 20: indel length: 0: CRISPR gRNA ID: GF-CCELg9-604: [crRNA sequence]
: crRNA sequence: AACCTCTTCCGCCTCCTGGAAGG (SEQ ID NO: 2355):
SpgRNA: attctaatacgactcactataggAACCTCTTCCGCCTCCTGGAgttttagagctagaaatagcaagttaaaataaggctagtccgtt
atcaacttgaaaaagtggcaccgagtcggtgc (SEQ ID NO: 2356): [Target gene information]: Gene ID: 4916: Symbol:
NTRK3: Ensembl Transcript ID: EN5T00000360948.2: GRCh: 37: Chr: 15: [Target cancer mutation
information]: mut start: 88799221: mut end: 88799221: mut class: Missense Mutation: mut type: SNP: ref
seq: G: mut seq: C: mut aa: p.P55R: mutation info source: CCLE: ref target(-10 +10):

TABLE 7-continued

Illustrative guide RNA sequences for polypeptides comprising Cas9

TTCCAGGAGGGGGAAGAGGTT (SEQ ID NO: 2349): mut target(-10 +10):
TTCCAGGAGGCGGAAGAGGTT (SEQ ID NO: 2350): [Model Cell line information]: cell: NCIH1563:
cancer type: LUNG: PAM dist: 10: indel length: 0: CRISPR gRNA ID: GF-CCELg9-605: [crRNA sequence]:
crRNA sequence: CTTCCGCCTCCTGGAAGGGCAGG (SEQ ID NO: 2357):
SpgRNA: attctaatacgactcactataggCTTCCGCCTCCTGGAAGGGCgttttagagctagaaatagcaagttaaaataaggctagtccgtt
atcaacttgaaaaagtggcaccgagtcggtgc (SEQ ID NO: 2358): [Target gene information]: Gene ID: 4916: Symbol:
NTRK3: Ensembl Transcript ID: EN5T00000360948.2: GRCh: 37: Chr: 15: [Target cancer mutation
information]: mut start: 88799221: mut end: 88799221: mut class: Missense Mutation: mut type: SNP: ref
seq: G: mut seq: C: mut aa: p.P55R: mutation info source: CCLE: ref target(-10 +10):
TTCCAGGAGGGGGAAGAGGTT (SEQ ID NO: 2349): mut target(-10 +10):
TTCCAGGAGGCGGAAGAGGTT (SEQ ID NO: 2350): [Model Cell line information]: cell: NCIH1563:
cancer type: LUNG: PAM dist: 15: indel length: 0: CRISPR gRNA ID: GF-CCELg9-606: [crRNA sequence]:
crRNA sequence: TGGGAACCTCTTCCGCCTCCTGG (SEQ ID NO: 2359):
SpgRNA: attctaatacgactcactataggTGGGAACCTCTTCCGCCTCCGgttttagagctagaaatagcaagttaaaataaggctagtccgtt
atcaacttgaaaaagtggcaccgagtcggtgc (SEQ ID NO: 2360): [Target gene information]: Gene ID: 4916: Symbol:
NTRK3: Ensembl Transcript ID: EN5T00000360948.2: GRCh: 37: Chr: 15: [Target cancer mutation
information]: mut start: 88799221: mut end: 88799221: mut class: Missense Mutation: mut type: SNP: ref
seq: G: mut seq: C: mut aa: p.P55R: mutation info source: CCLE: ref target(-10 +10):
TTCCAGGAGGGGGAAGAGGTT (SEQ ID NO: 2349): mut target(-10 +10):
TTCCAGGAGGCGGAAGAGGTT (SEQ ID NO: 2350): [Model Cell line information]: cell: NCIH1563:
cancer type: LUNG: PAM dist: 6: indel length: 0: CRISPR gRNA ID: GF-CCELg9-607: [crRNA sequence]:
crRNA sequence: ACCTCTTCCGCCTCCTGGAAGGG (SEQ ID NO: 2361):
SpgRNA: attctaatacgactcactataggACCTCTTCCGCCTCCTGGAAGGGgttttagagctagaaatagcaagttaaaataaggctagtccgtt
atcaacttgaaaaagtggcaccgagtcggtgc (SEQ ID NO: 2362): [Target gene information]: Gene ID: 4916: Symbol:
NTRK3: Ensembl Transcript ID: EN5T00000360948.2: GRCh: 37: Chr: 15: [Target cancer mutation
information]: mut start: 88799221: mut end: 88799221: mut class: Missense Mutation: mut type: SNP: ref
seq: G: mut seq: C: mut aa: p.P55R: mutation info source: CCLE: ref target(-10 +10):
TTCCAGGAGGGGGAAGAGGTT (SEQ ID NO: 2349): mut target(-10 +10):
TTCCAGGAGGCGGAAGAGGTT (SEQ ID NO: 2350): [Model Cell line information]: cell: NCIH1563:
cancer type: LUNG: PAM dist: 11: indel length: 0: CRISPR gRNA ID: GF-CCELg9-608: [crRNA sequence]:
crRNA sequence: TTGTGCTTGCCAGTGCAGCGTTGG (SEQ ID NO: 2363):
SpgRNA: attctaatacgactcactataggTTGTGCTGCCAGTGCAGCGTgttttagagctagaaatagcaagttaaaataaggctagtccgtt
atcaacttgaaaaagtggcaccgagtcggtgc (SEQ ID NO: 2364): [Target gene information]: Gene ID: 4916: Symbol:
NTRK3: Ensembl Transcript ID: EN5T00000360948.2: GRCh: 37: Chr: 15: [Target cancer mutation
information]: mut start: 88678529: mut end: 88678529: mut class: Missense Mutation: mut type: SNP: ref
seq: A: mut seq: T: mut aa: p.L336Q: mutation info source: CCLE: ref target(-10 +10):
CCCATTGTGCAGCCAGTGCAG (SEQ ID NO: 2365): mut target(-10 +10):
CCCATTGTGCTGCCAGTGCAG (SEQ ID NO: 2366): [Model Cell line information]: cell: NCIH2126:
cancer type: LUNG: PAM dist: 14: indel length: 0: CRISPR gRNA ID: GF-CCELg9-609: [crRNA sequence]:
crRNA sequence: TGCTGCCAGTGCAGCGTTGGTGG (SEQ ID NO: 2367):
SpgRNA: attctaatacgactcactataggTGCTGCCAGTGCAGCGTTGGgttttagagctagaaatagcaagttaaaataaggctagtccgtt
atcaacttgaaaaagtggcaccgagtcggtgc (SEQ ID NO: 2368): [Target gene information]: Gene ID: 4916: Symbol:
NTRK3: Ensembl Transcript ID: EN5T00000360948.2: GRCh: 37: Chr: 15: [Target cancer mutation
information]: mut start: 88678529: mut end: 88678529: mut class: Missense Mutation: mut type: SNP: ref
seq: A: mut seq: T: mut aa: p.L336Q: mutation info source: CCLE: ref target(-10 +10):
CCCATTGTGCAGCCAGTGCAG (SEQ ID NO: 2365): mut target(-10 +10):
CCCATTGTGCTGCCAGTGCAG (SEQ ID NO: 2366): [Model Cell line information]: cell: NCIH2126:
cancer type: LUNG: PAM dist: 17: indel length: 0: CRISPR gRNA ID: GF-CCELg9-610: [crRNA sequence]:
crRNA sequence: GCTGCCAGTGCAGCGTTGGTGGG (SEQ ID NO: 2369):
SpgRNA: attctaatacgactcactataggGCTGCCAGTGCAGCGTTGGTgttttagagctagaaatagcaagttaaaataaggctagtccgtt
atcaacttgaaaaagtggcaccgagtcggtgc (SEQ ID NO: 2370): [Target gene information]: Gene ID: 4916: Symbol:
NTRK3: Ensembl Transcript ID: EN5T00000360948.2: GRCh: 37: Chr: 15: [Target cancer mutation
information]: mut start: 88678529: mut end: 88678529: mut class: Missense Mutation: mut type: SNP: ref
seq: A: mut seq: T: mut aa: p.L336Q: mutation info source: CCLE: ref target(-10 +10):
CCCATTGTGCAGCCAGTGCAG (SEQ ID NO: 2365): mut target(-10 +10):
CCCATTGTGCTGCCAGTGCAG (SEQ ID NO: 2366): [Model Cell line information]: cell: NCIH2126:
cancer type: LUNG: PAM dist: 18: indel length: 0: CRISPR gRNA ID: GF-CCELg9-611: [crRNA sequence]:
crRNA sequence: CTGCCAGTGCAGCGTTGGTGGG (SEQ ID NO: 2371):
SpgRNA: attctaatacgactcactataggCTGCCAGTGCAGCGTTGGTGgttttagagctagaaatagcaagttaaaataaggctagtccgtt
atcaacttgaaaaagtggcaccgagtcggtgc (SEQ ID NO: 2372): [Target gene information]: Gene ID: 4916: Symbol:
NTRK3: Ensembl Transcript ID: EN5T00000360948.2: GRCh: 37: Chr: 15: [Target cancer mutation
information]: mut start: 88678529: mut end: 88678529: mut class: Missense Mutation: mut type: SNP: ref
seq: A: mut seq: T: mut aa: p.L336Q: mutation info source: CCLE: ref target(-10 +10):
CCCATTGTGCAGCCAGTGCAG (SEQ ID NO: 2365): mut target(-10 +10):
CCCATTGTGCTGCCAGTGCAG (SEQ ID NO: 2366): [Model Cell line information]: cell: NCIH2126:
cancer type: LUNG: PAM dist: 19: indel length: 0: CRISPR gRNA ID: GF-CCELg9-612: [crRNA sequence]:
crRNA sequence: TGCCAGTGCAGCGTTGGTGGGG (SEQ ID NO: 2373):
SpgRNA: attctaatacgactcactataggTGCCAGTGCAGCGTTGGTGGgttttagagctagaaatagcaagttaaaataaggctagtccgtt
atcaacttgaaaaagtggcaccgagtcggtgc (SEQ ID NO: 2374): [Target gene information]: Gene ID: 4916: Symbol:
NTRK3: Ensembl Transcript ID: EN5T00000360948.2: GRCh: 37: Chr: 15: [Target cancer mutation
information]: mut start: 88678529: mut end: 88678529: mut class: Missense Mutation: mut type: SNP: ref
seq: A: mut seq: T: mut aa: p.L336Q: mutation info source: CCLE: ref target(-10 +10):
CCCATTGTGCAGCCAGTGCAG (SEQ ID NO: 2365): mut target(-10 +10):
CCCATTGTGCTGCCAGTGCAG (SEQ ID NO: 2366): [Model Cell line information]: cell: NCIH2126:
cancer type: LUNG: PAM dist: 20: indel length: 0: CRISPR gRNA ID: GF-CCELg9-613: [crRNA sequence]:
crRNA sequence: ACGCTGCACTGGCAGCACAATGG (SEQ ID NO: 2375):
SpgRNA: attctaatacgactcactataggACGCTGCACTGGCAGCACAAgttttagagctagaaatagcaagttaaaataaggctagtccgt
tatcaacttgaaaaagtggcaccgagtcggtgc (SEQ ID NO: 23 76): [Target gene information]: Gene ID: 4916: Symbol:

TABLE 7-continued

Illustrative guide RNA sequences for polypeptides comprising Cas9

NTRK3: Ensembl Transcript ID: ENST00000360948.2: GRCh: 37: Chr: 15: [Target cancer mutation
information]: mut start: 88678529: mut end: 88678529: mut class: Missense Mutation: mut type: SNP: ref
seq: A: mut seq: T: mut aa: p.L336Q: mutation info source: CCLE: ref target(-10 +10):
CCCATTGTGCAGCCAGTGCAG (SEQ ID NO: 2365): mut target(-10 +10):
CCCATTGTGCTGCCAGTGCAG (SEQ ID NO: 2366): [Model Cell line information]: cell: NCIH2126:
cancer type: LUNG: PAM dist: 7: indel length: 0: CRISPR gRNA ID: GF-CCELg9-614: [crRNA sequence]:
crRNA sequence: AGCACAATGGGCAGCCTCTGCGG (SEQ ID NO: 2377):
SpgRNA: attctaatacgactcactataggAGCACAATGGGCAGCCTCTGgttttagagctagaaatagcaagttaaaataaggctagtccgtt
atcaacttgaaaaagtggcaccgagtcggtgc (SEQ ID NO: 23 78): [Target gene information]: Gene ID: 4916: Symbol:
NTRK3: Ensembl Transcript ID: EN5T00000360948.2: GRCh: 37: Chr: 15: [Target cancer mutation
information]: mut start: 88678529: mut end: 88678529: mut class: Missense Mutation: mut type: SNP: ref
seq: A: mut seq: T: mut aa: p.L336Q: mutation info source: CCLE: ref target(-10 +10):
CCCATTGTGCAGCCAGTGCAG (SEQ ID NO: 2365): mut target(-10 +10):
CCCATTGTGCTGCCAGTGCAG (SEQ ID NO: 2366): [Model Cell line information]: cell: NCIH2126:
cancer type: LUNG: PAM dist: 20: indel length: 0: CRISPR gRNA ID: GF-CCELg9-615: [crRNA sequence]:
crRNA sequence: CGCTGCACTGGCAGCACAATGGG (SEQ ID NO: 2379):
SpgRNA: attctaatacgactcactataggCGCTGCACTGGCAGCACAATGgttttagagctagaaatagcaagttaaaataaggctagtccgtt
atcaacttgaaaaagtggcaccgagtcggtgc (SEQ ID NO: 23 80): [Target gene information]: Gene ID: 4916: Symbol:
NTRK3: Ensembl Transcript ID: EN5T00000360948.2: GRCh: 37: Chr: 15: [Target cancer mutation
information]: mut start: 88678529: mut end: 88678529: mut class: Missense Mutation: mut type: SNP: ref
seq: A: mut seq: T: mut aa: p.L336Q: mutation info source: CCLE: ref target(-10 +10):
CCCATTGTGCAGCCAGTGCAG (SEQ ID NO: 2365): mut target(-10 +10):
CCCATTGTGCTGCCAGTGCAG (SEQ ID NO: 2366): [Model Cell line information]: cell: NCIH2126:
cancer type: LUNG: PAM dist: 8: indel length: 0: CRISPR gRNA ID: GF-CCELg9-616: [crRNA sequence]:
crRNA sequence: ACTATTCTCCCTGTACTTTTCGG (SEQ ID NO: 2381):
SpgRNA: attctaatacgactcactataggACTATTCTCCCTGTACTTTTgttttagagctagaaatagcaagttaaaataaggctagtccgttat
caacttgaaaaagtggcaccgagtcggtgc (SEQ ID NO: 23 82): [Target gene information]: Gene ID: 57144: Symbol:
PAK7: Ensembl Transcript ID: EN5T00000378429.3: GRCh: 37: Chr: 20: [Target cancer mutation
information]: mut start: 9561335: mut end: 9561335: mut class: Missense Mutation: mut type: SNP: ref seq:
C: mut seq: A: mut aa: p.K149N: mutation info source: CCLE: ref target(-10 +10):
CATAGAGACTCTTCTCCCTGT (SEQ ID NO: 2383): mut target(-10 +10):
CATAGAGACTATTCTCCCTGT (SEQ ID NO: 23 84): [Model Cell line information]: cell: A549: cancer
type: LUNG: PAM dist: 17: indel length: 0: CRISPR gRNA ID: GF-CCELg9-617: [crRNA sequence]:
crRNA sequence: TACAGGGAGAATAGTCTCTATGG (SEQ ID NO: 2385):
SpgRNA: attctaatacgactcactataggTACAGGGAGAATAGTCTCTAgttttagagctagaaatagcaagttaaaataaggctagtccgtt
atcaacttgaaaaagtggcaccgagtcggtgc (SEQ ID NO: 2386): [Target gene information]: Gene ID: 57144:
Symbol: PAK7: Ensembl Transcript ID: EN5T00000378429.3: GRCh: 37: Chr: 20: [Target cancer mutation
information]: mut start: 9561335: mut end: 9561335: mut class: Missense Mutation: mut type: SNP: ref seq:
C: mut seq: A: mut aa: p.K149N: mutation info source: CCLE: ref target(-10 +10):
CATAGAGACTCTTCTCCCTGT (SEQ ID NO: 2383): mut target(-10 +10):
CATAGAGACTATTCTCCCTGT (SEQ ID NO: 23 84): [Model Cell line information]: cell: A549: cancer
type: LUNG: PAM dist: 9: indel length: 0: CRISPR gRNA ID: GF-CCELg9-618: [crRNA sequence]: crRNA
sequence: TAGTCTCTATGGAGATGATCTGG (SEQ ID NO: 2387):
SpgRNA: attctaatacgactcactataggTAGTCTCTATGGAGATGATCgttttagagctagaaatagcaagttaaaataaggctagtccgtt
atcaacttgaaaaagtggcaccgagtcggtgc (SEQ ID NO: 2388): [Target gene information]: Gene ID: 57144:
Symbol: PAK7: Ensembl Transcript ID: EN5T00000378429.3: GRCh: 37: Chr: 20: [Target cancer mutation
information]: mut start: 9561335: mut end: 9561335: mut class: Missense Mutation: mut type: SNP: ref seq:
C: mut seq: A: mut aa: p.K149N: mutation info source: CCLE: ref target(-10 +10):
CATAGAGACTCTTCTCCCTGT (SEQ ID NO: 2383): mut target(-10 +10):
CATAGAGACTATTCTCCCTGT (SEQ ID NO: 23 84): [Model Cell line information]: cell: A549: cancer
type: LUNG: PAM dist: 20: indel length: 0: CRISPR gRNA ID: GF-CCELg9-619: [crRNA sequence]:
crRNA sequence: CTAAGTCAAGTATTCGAATGAGG (SEQ ID NO: 2389):
SpgRNA: attctaatacgactcactataggCTAAGTCAAGTATTCGAATGgttttagagctagaaatagcaagttaaaataaggctagtccgtt
atcaacttgaaaaagtggcaccgagtcggtgc (SEQ ID NO: 2390): [Target gene information]: Gene ID: 55193:
Symbol: PBRM1: Ensembl Transcript ID: EN5T00000296302.7: GRCh: 37: Chr: 3: [Target cancer mutation
information]: mut start: 52678730: mut end: 52678730: mut class: Missense Mutation: mut type: SNP: ref
seq: G: mut seq: T: mut aa: p.L297I: mutation info source: CCLE: ref target(-10 +10):
CTCATTCGAAGACTTGACTTA (SEQ ID NO: 669): mut target(-10 +10):
CTCATTCGAATACTTGACTTA (SEQ ID NO: 670): [Model Cell line information]: cell: NCIH1975:
cancer type: LUNG: PAM dist: 9: indel length: 0: CRISPR gRNA ID: GF-CCELg9-620: [crRNA sequence]:
crRNA sequence: GTCAAGTATTCGAATGAGGTAGG (SEQ ID NO: 2391):
SpgRNA: attctaatacgactcactataggGTCAAGTATTCGAATGAGGTgttttagagctagaaatagcaagttaaaataaggctagtccgtt
atcaacttgaaaaagtggcaccgagtcggtgc (SEQ ID NO: 2392): [Target gene information]: Gene ID: 55193:
Symbol: PBRM1: Ensembl Transcript ID: EN5T00000296302.7: GRCh: 37: Chr: 3: [Target cancer mutation
information]: mut start: 52678730: mut end: 52678730: mut class: Missense Mutation: mut type: SNP: ref
seq: G: mut seq: T: mut aa: p.L297I: mutation info source: CCLE: ref target(-10 +10):
CTCATTCGAAGACTTGACTTA (SEQ ID NO: 669): mut target(-10 +10):
CTCATTCGAATACTTGACTTA (SEQ ID NO: 670): [Model Cell line information]: cell: NCIH1975:
cancer type: LUNG: PAM dist: 13: indel length: 0: CRISPR gRNA ID: GF-CCELg9-621: [crRNA sequence]:
crRNA sequence: GAAGAATACAAACAACTCAGAGG (SEQ ID NO: 2393):
SpgRNA: attctaatacgactcactataggGAAGAATACAAACAACTCAGgttttagagctagaaatagcaagttaaaataaggctagtccgt
tatcaacttgaaaaagtggcaccgagtcggtgc (SEQ ID NO: 2394): [Target gene information]: Gene ID: 55193:
Symbol: PBRM1: Ensembl Transcript ID: EN5T00000296302.7: GRCh: 37: Chr: 3: [Target cancer mutation
information]: mut start: 52620488: mut end: 52620488: mut class: Missense Mutation: mut type: SNP: ref
seq: C: mut seq: T: mut aa: p.D1114N: mutation info source: CCLE: ref target(-10 +10):
TCTGAGTTGTCTGTATTCTTC (SEQ ID NO: 675): mut target(-10 +10):
TCTGAGTTGTTTGTATTCTTC (SEQ ID NO: 676): [Model Cell line information]: cell: NCIH1563:
cancer type: LUNG: PAM dist: 10: indel length: 0: CRISPR gRNA ID: GF-CCELg9-622: [crRNA sequence]:

TABLE 7-continued

Illustrative guide RNA sequences for polypeptides comprising Cas9

```
crRNA sequence: TGCCTCGCTAAGAATCTCCTTGG (SEQ ID NO: 2395):
SpgRNA: attctaatacgactcactataggTGCCTCGCTAAGAATCTCCTgttttagagctagaaatagcaagttaaaataaggctagtccgtt
atcaacttgaaaaagtggcaccgagtcggtgc (SEQ ID NO: 2396): [Target gene information]: Gene ID: 5156: Symbol:
PDGFRA: Ensembl Transcript ID: EN5T00000257290.5: GRCh: 37: Chr: 4: [Target cancer mutation
information]: mut start: 55139845: mut end: 55139845: mut class: Silent: mut type: SNP: ref seq: G: mut
seq: C: mut aa: p.L502L: mutation info source: CCLE: ref target(-10 +10):
TGCGATGCCTGGCTAAGAATC (SEQ ID NO: 2397): mut target(-10 +10):
TGCGATGCCTCGCTAAGAATC (SEQ ID NO: 2398): [Model Cell line information]: cell: NCIH1975:
cancer type: LUNG: PAM dist: 15: indel length: 0: CRISPR gRNA ID: GF-CCELg9-623: [crRNA sequence]:
crRNA sequence: CTCCAAGGAGATTCTTAGCGAGG (SEQ ID NO: 2399):
SpgRNA: attctaatacgactcactataggCTCCAAGGAGATTCTTAGCGAGGgttttagagctagaaatagcaagttaaaataaggctagtccgtt
atcaacttgaaaaagtggcaccgagtcggtgc (SEQ ID NO: 2400): [Target gene information]: Gene ID: 5156: Symbol:
PDGFRA: Ensembl Transcript ID: EN5T00000257290.5: GRCh: 37: Chr: 4: [Target cancer mutation
information]: mut start: 55139845: mut end: 55139845: mut class: Silent: mut type: SNP: ref seq: G: mut
seq: C: mut aa: p.L502L: mutation info source: CCLE: ref target(-10 +10):
TGCGATGCCTGGCTAAGAATC (SEQ ID NO: 2397): mut target(-10 +10):
TGCGATGCCTCGCTAAGAATC (SEQ ID NO: 2398): [Model Cell line information]: cell: NCIH1975:
cancer type: LUNG: PAM dist: 1: indel length: 0: CRISPR gRNA ID: GF-CCELg9-624: [crRNA sequence]:
crRNA sequence: AGCGAGGCATCGCACGGCGATGG (SEQ ID NO: 2401):
SpgRNA: attctaatacgactcactataggAGCGAGGCATCGCACGGCGAgttttagagctagaaatagcaagttaaaataaggctagtccgt
tatcaacttgaaaaagtggcaccgagtcggtgc (SEQ ID NO: 2402): [Target gene information]: Gene ID: 5156: Symbol:
PDGFRA: Ensembl Transcript ID: ENST00000257290.5: GRCh: 37: Chr: 4: [Target cancer mutation
information]: mut start: 55139845: mut end: 55139845: mut class: Silent: mut type: SNP: ref seq: G: mut
seq: C: mut aa: p.L502L: mutation info source: CCLE: ref target(-10 +10):
TGCGATGCCTGGCTAAGAATC (SEQ ID NO: 2397): mut target(-10 +10):
TGCGATGCCTCGCTAAGAATC (SEQ ID NO: 2398): [Model Cell line information]: cell: NCIH1975:
cancer type: LUNG: PAM dist: 17: indel length: 0: CRISPR gRNA ID: GF-CCELg9-625: [crRNA sequence]:
crRNA sequence: ATTCTTAGCGAGGCATCGCACGG (SEQ ID NO: 2403):
SpgRNA: attctaatacgactcactataggATTCTTAGCGAGGCATCGCAg ttttagagctagaaatagcaagttaaaataaggctagtccgtt
atcaacttgaaaaagtggcaccgagtcggtgc (SEQ ID NO: 2404): [Target gene information]: Gene ID: 5156: Symbol:
PDGFRA: Ensembl Transcript ID: EN5T00000257290.5: GRCh: 37: Chr: 4: [Target cancer mutation
information]: mut start: 55139845: mut end: 55139845: mut class: Silent: mut type: SNP: ref seq: G: mut
seq: C: mut aa: p.L502L: mutation info source: CCLE: ref target(-10 +10):
TGCGATGCCTGGCTAAGAATC (SEQ ID NO: 2397): mut target(-10 +10):
TGCGATGCCTCGCTAAGAATC (SEQ ID NO: 2398): Model Cell line information]: cell: NCIH1975:
cancer type: LUNG: PAM dist: 11: indel length: 0: CRISPR gRNA ID: GF-CCELg9-626: [crRNA sequence]:
crRNA sequence: TTCAGATGTCTGCGAGCTGGAGG (SEQ ID NO: 2405):
SpgRNA: attctaatacgactcactataggTTCAGATGTCTGCGAGCTGGAG ttttagagctagaaatagcaagttaaaataaggctagtccgtt
atcaacttgaaaaagtggcaccgagtcggtgc (SEQ ID NO: 2406): [Target gene information]: Gene ID: 5156: Symbol:
PDGFRA: Ensembl Transcript ID: EN5T00000257290.5: GRCh: 37: Chr: 4: [Target cancer mutation
information]: mut start: 55161301: mut end: 55161301: mut class: Silent: mut type: SNP: ref seq: C: mut
seq: A: mut aa: p.T1044T: mutation info source: CCLE: ref target(-10 +10):
GCTCGCAGACCTCTGAAGAGA (SEQ ID NO: 2407): mut target(-10 +10):
GCTCGCAGACATCTGAAGAGA (SEQ ID NO: 2408): [Model Cell line information]: cell: NCIH1573:
cancer type: LUNG: PAM dist: 14: indel length: 0: CRISPR gRNA ID: GF-CCELg9-627: [crRNA sequence]:
crRNA sequence: AGATGTCTGCGAGCTGGAGGAGG (SEQ ID NO: 2409):
SpgRNA: attctaatacgactcactataggAGATGTCTGCGAGCTGGAGGg ttttagagctagaaatagcaagttaaaataaggctagtccgtt
tatcaacttgaaaaagtggcaccgagtcggtgc (SEQ ID NO: 2410): [Target gene information]: Gene ID: 5156: Symbol:
PDGFRA: Ensembl Transcript ID: EN5T00000257290.5: GRCh: 37: Chr: 4: [Target cancer mutation
information]: mut start: 55161301: mut end: 55161301: mut class: Silent: mut type: SNP: ref seq: C: mut
seq: A: mut aa: p.T1044T: mutation info source: CCLE: ref target(-10 +10):
GCTCGCAGACCTCTGAAGAGA (SEQ ID NO: 2407): mut target(-10 +10):
GCTCGCAGACATCTGAAGAGA (SEQ ID NO: 2408): [Model Cell line information]: cell: NCIH1573:
cancer type: LUNG: PAM dist: 17: indel length: 0: CRISPR gRNA ID: GF-CCELg9-628: [crRNA sequence]:
crRNA sequence: CTCTTCAGATGTCTGCGAGCTGG (SEQ ID NO: 2411):
SpgRNA: attctaatacgactcactataggCTCTTCAGATGTCTGCGAGCgttttagagctagaaatagcaagttaaaataaggctagtccgtt
atcaacttgaaaaagtggcaccgagtcggtgc (SEQ ID NO: 2412): [Target gene information]: Gene ID: 5156: Symbol:
PDGFRA: Ensembl Transcript ID: EN5T00000257290.5: GRCh: 37: Chr: 4: [Target cancer mutation
information]: mut start: 55161301: mut end: 55161301: mut class: Silent: mut type: SNP: ref seq: C: mut
seq: A: mut aa: p.T1044T: mutation info source: CCLE: ref target(-10 +10):
GCTCGCAGACCTCTGAAGAGA (SEQ ID NO: 2407): mut target(-10 +10):
GCTCGCAGACATCTGAAGAGA (SEQ ID NO: 2408): [Model Cell line information]: cell: NCIH1573:
cancer type: LUNG: PAM dist: 11: indel length: 0: CRISPR gRNA ID: GF-CCELg9-629: [crRNA sequence]:
crRNA sequence: GATGTCTGCGAGCTGGAGGAGGG (SEQ ID NO: 2413):
SpgRNA: attctaatacgactcactataggGATGTCTGCGAGCTGGAGGAgttttagagctagaaatagcaagttaaaataaggctagtccgt
tatcaacttgaaaaagtggcaccgagtcggtgc (SEQ ID NO: 2414): [Target gene information]: Gene ID: 5156: Symbol:
PDGFRA: Ensembl Transcript ID: EN5T00000257290.5: GRCh: 37: Chr: 4: [Target cancer mutation
information]: mut start: 55161301: mut end: 55161301: mut class: Silent: mut type: SNP: ref seq: C: mut
seq: A: mut aa: p.T1044T: mutation info source: CCLE: ref target(-10 +10):
GCTCGCAGACCTCTGAAGAGA (SEQ ID NO: 2407): mut target(-10 +10):
GCTCGCAGACATCTGAAGAGA (SEQ ID NO: 2408): [Model Cell line information]: cell: NCIH1573:
cancer type: LUNG: PAM dist: 18: indel length: 0: CRISPR gRNA ID: GF-CCELg9-630: [crRNA sequence]:
crRNA sequence: GTTGATCAGAGTTGCTCGGCAGG (SEQ ID NO: 2415):
SpgRNA: attctaatacgactcactataggGTTGATCAGAGTTGCTCGGCgttttagagctagaaatagcaagttaaaataaggctagtccgtt
atcaacttgaaaaagtggcaccgagtcggtgc (SEQ ID NO: 2416): [Target gene information]: Gene ID: 5159: Symbol:
PDGFRB: Ensembl Transcript ID: ENST00000261799.4: GRCh: 37: Chr: 5: [Target cancer mutation
information]: mut start: 149500859: mut end: 149500859: mut class: Silent: mut type: SNP: ref seq: A: mut
seq: G: mut aa: p.L791L: mutation info source: CCLE: ref target(-10 +10): TCGTTGATCAAAGTTGCTCGG
```

TABLE 7-continued

Illustrative guide RNA sequences for polypeptides comprising Cas9

(SEQ ID NO: 2417): mut target(-10 +10): TCGTTGATCAGAGTTGCTCGG (SEQ ID NO: 2418): [Model Cell line information]: cell: HPAFII: cancer type: PANCREAS: PAM dist: 12: indel length: 0: CRISPR gRNA ID: GF-CCELg9-631: [crRNA sequence]: crRNA sequence: ACTCGTTGATCAGAGTTGCTCGG
(SEQ ID NO: 2419):
SpgRNA: attctaatacgactcactataggACTCGTTGATCAGAGTTGCTgttttagagctagaaatagcaagttaaaataaggctagtccgtt atcaacttgaaaaagtggcaccgagtcggtgc (SEQ ID NO: 2420): [Target gene information]: Gene ID: 5159: Symbol: PDGFRB: Ensembl Transcript ID: ENST00000261799.4: GRCh: 37: Chr: 5: [Target cancer mutation information]: mut start: 149500859: mut end: 149500859: mut class: Silent: mut type: SNP: ref seq: A: mut seq: G: mut aa: p.L791L: mutation info source: CCLE: ref target(-10 +10): TCGTTGATCAAAGTTGCTCGG
(SEQ ID NO: 2417): mut target(-10 +10): TCGTTGATCAGAGTTGCTCGG (SEQ ID NO: 2418): [Model Cell line information]: cell: HPAFII: cancer type: PANCREAS: PAM dist: 8: indel length: 0: CRISPR gRNA ID: GF-CCELg9-632: [crRNA sequence]: crRNA sequence: CCTTCTGCCAAAGCATAATGAGG (SEQ ID NO: 2421):
SpgRNA: attctaatacgactcactataggCCTTCTGCCAAAGCATAATGgttttagagctagaaatagcaagttaaaataaggctagtccgtt atcaacttgaaaaagtggcaccgagtcggtgc (SEQ ID NO: 2422): [Target gene information]: Gene ID: 5159: Symbol: PDGFRB: Ensembl Transcript ID: ENST00000261799.4: GRCh: 37: Chr: 5: [Target cancer mutation information]: mut start: 149506098: mut end: 149506098: mut class: Silent: mut type: SNP: ref seq: G: mut seq: A: mut aa: p.I553I: mutation info source: CCLE: ref target(-10 +10): GCCAAAGCATGATGAGGATGA
(SEQ ID NO: 2423): mut target(-10 +10): GCCAAAGCATAATGAGGATGA (SEQ ID NO: 2424):
[Model Cell line information]: cell: NCIH1563: cancer type: LUNG: PAM dist: 4: indel length: 0: CRISPR gRNA ID: GF-CCELg9-633: [crRNA sequence]: crRNA sequence: AAAGCATAATGAGGATGATAAGG
(SEQ ID NO: 2425):
SpgRNA: attctaatacgactcactataggAAAGCATAATGAGGATGATAgttttagagctagaaatagcaagttaaaataaggctagtccgt tatcaacttgaaaaagtggcaccgagtcggtgc (SEQ ID NO: 2426): [Target gene information]: Gene ID: 5159: Symbol: PDGFRB: Ensembl Transcript ID: ENST00000261799.4: GRCh: 37: Chr: 5: [Target cancer mutation information]: mut start: 149506098: mut end: 149506098: mut class: Silent: mut type: SNP: ref seq: G: mut seq: A: mut aa: p.I553I: mutation info source: CCLE: ref target(-10 +10): GCCAAAGCATGATGAGGATGA
(SEQ ID NO: 2423): mut target(-10 +10): GCCAAAGCATAATGAGGATGA (SEQ ID NO: 2424):
[Model Cell line information]: cell: NCIH1563: cancer type: LUNG: PAM dist: 13: indel length: 0: CRISPR gRNA ID: GF-CCELg9-634: [crRNA sequence]: crRNA sequence: AAGCATAATGAGGATGATAAGGG
(SEQ ID NO: 2427):
SpgRNA: attctaatacgactcactataggAAGCATAATGAGGATGATAAg agagctagaaatagcaagttaaaataaggctagtccgt tatcaacttgaaaaagtggcaccgagtcggtgc (SEQ ID NO: 2428): [Target gene information]: Gene ID: 5159: Symbol: PDGFRB: Ensembl Transcript ID: ENST00000261799.4: GRCh: 37: Chr: 5: [Target cancer mutation information]: mut start: 149506098: mut end: 149506098: mut class: Silent: mut type: SNP: ref seq: G: mut seq: A: mut aa: p.I553I: mutation info source: CCLE: ref target(-10 +10): GCCAAAGCATGATGAGGATGA
(SEQ ID NO: 2423): mut target(-10 +10): GCCAAAGCATAATGAGGATGA (SEQ ID NO: 2424):
[Model Cell line information]: cell: NCIH1563: cancer type: LUNG: PAM dist: 14: indel length: 0: CRISPR gRNA ID: GF-CCELg9-635: [crRNA sequence]: crRNA sequence: CCTCATTTATGCTTTGGCAGAAGG
(SEQ ID NO: 2429):
SpgRNA: attctaatacgactcactataggCCTCATTATGCTTTGGCAGAgttttagagctagaaatagcaagttaaaataaggctagtccgtt atcaacttgaaaaagtggcaccgagtcggtgc (SEQ ID NO: 243 0): [Target gene information]: Gene ID: 5159: Symbol: PDGFRB: Ensembl Transcript ID: ENST00000261799.4: GRCh: 37: Chr: 5: [Target cancer mutation information]: mut start: 149506098: mut end: 149506098: mut class: Silent: mut type: SNP: ref seq: G: mut seq: A: mut aa: p.I553I: mutation info source: CCLE: ref target(-10 +10): GCCAAAGCATGATGAGGATGA
(SEQ ID NO: 2423): mut target(-10 +10): GCCAAAGCATAATGAGGATGA (SEQ ID NO: 2424):
[Model Cell line information]: cell: NCIH1563: cancer type: LUNG: PAM dist: 14: indel length: 0: CRISPR gRNA ID: GF-CCELg9-636: [crRNA sequence]: crRNA sequence: TTATCATCCTCATTTATGCTTTGG
(SEQ ID NO: 2431):
SpgRNA: attctaatacgactcactataggTTATCATCCTCATTATGCTTgttttagagctagaaatagcaagttaaaataaggctagtccgttat caacttgaaaaagtggcaccgagtcggtgc (SEQ ID NO: 2432): [Target gene information]: Gene ID: 5159: Symbol: PDGFRB: Ensembl Transcript ID: ENST00000261799.4: GRCh: 37: Chr: 5: [Target cancer mutation information]: mut start: 149506098: mut end: 149506098: mut class: Silent: mut type: SNP: ref seq: G: mut seq: A: mut aa: p.I553I: mutation info source: CCLE: ref target(-10 +10): GCCAAAGCATGATGAGGATGA
(SEQ ID NO: 2423): mut target(-10 +10): GCCAAAGCATAATGAGGATGA (SEQ ID NO: 2424):
[Model Cell line information]: cell: NCIH1563: cancer type: LUNG: PAM dist: 7: indel length: 0: CRISPR gRNA ID: GF-CCELg9-637: [crRNA sequence]: crRNA sequence: GCAGGAATATAACACCACGCTGG
(SEQ ID NO: 2433):
SpgRNA: attctaatacgactcactataggGCAGGAATATAACACCACGCgttttagagctagaaatagcaagttaaaataaggctagtccgt tatcaacttgaaaaagtggcaccgagtcggtgc (SEQ ID NO: 243 4): [Target gene information]: Gene ID: 5170: Symbol: PDPK1: Ensembl Transcript ID: EN5T00000342085.4: GRCh: 37: Chr: 16: [Target cancer mutation information]: mut start: 2607741: mut end: 2607741: mut class: Missense Mutation: mut type: SNP: ref seq: G: mut seq: A: mut aa: p.C21Y: mutation info source: CCLE: ref target(-10 +10): GTGGTGTTATGTTCCTGCCCA (SEQ ID NO: 2435): mut target(-10 +10): GTGGTGTTATATTCCTGCCCA (SEQ ID NO: 2436): [Model Cell line information]: cell: A549: cancer type: LUNG: PAM dist: 13: indel length: 0: CRISPR gRNA ID: GF-CCELg9-638: [crRNA sequence]: crRNA sequence: AATATAACACCACGCTGGACTGG (SEQ ID NO: 2437):
SpgRNA: attctaatacgactcactataggAATATAACACCACGCTGGACgttttagagctagaaatagcaagttaaaataaggctagtccgtt atcaacttgaaaaagtggcaccgagtcggtgc (SEQ ID NO: 243 8): [Target gene information]: Gene ID: 5170: Symbol: PDPK1: Ensembl Transcript ID: EN5T00000342085.4: GRCh: 37: Chr: 16: [Target cancer mutation information]: mut start: 2607741: mut end: 2607741: mut class: Missense Mutation: mut type: SNP: ref seq: G: mut seq: A: mut aa: p.C21Y: mutation info source: CCLE: ref target(-10 +10): GTGGTGTTATGTTCCTGCCCA (SEQ ID NO: 2435): mut target(-10 +10): GTGGTGTTATATTCCTGCCCA (SEQ ID NO: 2436): [Model Cell line information]: cell: A549: cancer type: LUNG: PAM dist: 18: indel length: 0: CRISPR gRNA ID: GF-CCELg9-639: [crRNA sequence]: crRNA sequence: CGGAGAAGTCTGCCTGTAAGAGG (SEQ ID NO: 2439):

TABLE 7-continued

Illustrative guide RNA sequences for polypeptides comprising Cas9

SpgRNA: attctaatacgactcactataggCGGAGAAGTCTGCCTGTAAGgttttagagctagaaatagcaagttaaaataaggctagtccgtt
atcaacttgaaaaagtggcaccgagtcggtgc (SEQ ID NO: 2440): [Target gene information]: Gene ID: 5170: Symbol:
PDPK1: Ensembl Transcript ID: EN5T00000342085.4: GRCh: 37: Chr: 16: [Target cancer mutation
informa-
tion]: mut start: 2627490: mut end: 2627490: mut class: Silent: mut type: SNP: ref seq: C: mut seq:
T: mut aa: p.52585: mutation info source: CCLE: ref target(-10 +10): CGGAGAAGTCCGCCTGTAAGA
(SEQ ID NO: 2441): mut target(-10 +10): CGGAGAAGTCTGCCTGTAAGA (SEQ ID NO: 2442):
[Model Cell line information]: cell: CFPAC1: cancer type: PANCREAS: PAM dist: 10: indel length: 0:
CRISPR gRNA ID: GF-CCELg9-640: [crRNA sequence]: crRNA sequence:
ATGGTTCAATGCTCATTAACAGG (SEQ ID NO: 2443):
SpgRNA: attctaatacgactcactataggATGGTTCAATGCTCATTAACgttttagagctagaaatagcaagttaaaataaggctagtccgtt
atcaacttgaaaaagtggcaccgagtcggtgc (SEQ ID NO: 2444): [Target gene information]: Gene ID: 5241: Symbol:
PGR: Ensembl Transcript ID: EN5T00000325455.5: GRCh: 37: Chr: 11: [Target cancer mutation
information]: mut start: 100933301: mut end: 100933301: mut class: Missense Mutation: mut type: SNP: ref
seq: C: mut seq: A: mut aa: p.D697Y: mutation info source: CCLE: ref target(-10 +10):
TAGATCACATCTGGTTCAATG (SEQ ID NO: 2445): mut target(-10 +10):
TAGATCACATATGGTTCAATG (SEQ ID NO: 2446): [Model Cell line information]: cell: NCIH2126:
cancer type: LUNG: PAM dist: 20: indel length: 0: CRISPR gRNA ID: GF-CCELg9-641: [crRNA sequence]:
crRNA sequence: TGTCCTGCATAGATCACATATGG (SEQ ID NO: 2447):
SpgRNA: attctaatacgactcactataggTGTCCTGCATAGATCACATAgttttagagctagaaatagcaagttaaaataaggctagtccgtt
atcaacttgaaaaagtggcaccgagtcggtgc (SEQ ID NO: 2448): [Target gene information]: Gene ID: 5241: Symbol:
PGR: Ensembl Transcript ID: EN5T00000325455.5: GRCh: 37: Chr: 11: [Target cancer mutation
information]: mut start: 100933301: mut end: 100933301: mut class: Missense Mutation: mut type: SNP: ref
seq: C: mut seq: A: mut aa: p.D697Y: mutation info source: CCLE: ref target(-10 +10):
TAGATCACATCTGGTTCAATG (SEQ ID NO: 2445): mut target(-10 +10):
TAGATCACATATGGTTCAATG (SEQ ID NO: 2446): [Model Cell line information]: cell: NCIH2126:
cancer type: LUNG: PAM dist: 1: indel length: 0: CRISPR gRNA ID: GF-CCELg9-642: [crRNA sequence]:
crRNA sequence: GAACCATATGTGATCTATGCAGG (SEQ ID NO: 2449):
SpgRNA: attctaatacgactcactataggGAACCATATGTGATCTATGCgttttagagctagaaatagcaagttaaaataaggctagtccgtt
atcaacttgaaaaagtggcaccgagtcggtgc (SEQ ID NO: 2450): [Target gene information]: Gene ID: 5241: Symbol:
PGR: Ensembl Transcript ID: EN5T00000325455.5: GRCh: 37: Chr: 11: [Target cancer mutation
information]: mut start: 100933301: mut end: 100933301: mut class: Missense Mutation: mut type: SNP: ref
seq: C: mut seq: A: mut aa: p.D697Y: mutation info source: CCLE: ref target(-10 +10):
TAGATCACATCTGGTTCAATG (SEQ ID NO: 2445): mut target(-10 +10):
TAGATCACATATGGTTCAATG (SEQ ID NO: 2446): [Model Cell line information]: cell: NCIH2126:
cancer type: LUNG: PAM dist: 14: indel length: 0: CRISPR gRNA ID: GF-CCELg9-643: [crRNA sequence]:
crRNA sequence: GCTCTTCACTAAGCCGGCTTTGG (SEQ ID NO: 2451):
SpgRNA: attctaatacgactcactataggGCTCTTCACTAAGCCGGCTTgttttagagctagaaatagcaagttaaaataaggctagtccgtt
atcaacttgaaaaagtggcaccgagtcggtgc (SEQ ID NO: 2452): [Target gene information]: Gene ID: 8929: Symbol:
PHOX2B: Ensembl Transcript ID: EN5T00000226382.2: GRCh: 37: Chr: 4: [Target cancer mutation
information]: mut start: 41747849: mut end: 41747849: mut class: Missense Mutation: mut type: SNP: ref
seq: G: mut seq: C: mut aa: p.A307G: mutation info source: CCLE: ref target(-10 +10):
CTTCACTAAGGCGGCTTTGGC (SEQ ID NO: 2453): mut target(-10 +10):
CTTCACTAAGCCGGCTTTGGC (SEQ ID NO: 2454): [Model Cell line information]: cell: NCIH1573:
cancer type: LUNG: PAM dist: 7: indel length: 0: CRISPR gRNA ID: GF-CCELg9-644: [crRNA sequence]:
crRNA sequence: TAAGCCGGCTTTGGCACCGTTGG (SEQ ID NO: 2455):
SpgRNA: attctaatacgactcactataggTAAGCCGGCTTTGGCACCGTgttttagagctagaaatagcaagttaaaataaggctagtccgtt
atcaacttgaaaaagtggcaccgagtcggtgc (SEQ ID NO: 2456): [Target gene information]: Gene ID: 8929: Symbol:
PHOX2B: Ensembl Transcript ID: EN5T00000226382.2: GRCh: 37: Chr: 4: [Target cancer mutation
information]: mut start: 41747849: mut end: 41747849: mut class: Missense Mutation: mut type: SNP: ref
seq: G: mut seq: C: mut aa: p.A307G: mutation info source: CCLE: ref target(-10 +10):
CTTCACTAAGGCGGCTTTGGC (SEQ ID NO: 2453): mut target(-10 +10):
CTTCACTAAGCCGGCTTTGGC (SEQ ID NO: 2454): [Model Cell line information]: cell: NCIH1573:
cancer type: LUNG: PAM dist: 16: indel length: 0: CRISPR gRNA ID: GF-CCELg9-645: [crRNA sequence]:
crRNA sequence: CATACTGCTCTTCACTAAGCCGG (SEQ ID NO: 2457):
SpgRNA: attctaatacgactcactataggCATACTGCTCTTCACTAAGCCGGgttttagagctagaaatagcaagttaaaataaggctagtccgtt
atcaacttgaaaaagtggcaccgagtcggtgc (SEQ ID NO: 2458): [Target gene information]: Gene ID: 8929: Symbol:
PHOX2B: Ensembl Transcript ID: EN5T00000226382.2: GRCh: 37: Chr: 4: [Target cancer mutation
information]: mut start: 41747849: mut end: 41747849: mut class: Missense Mutation: mut type: SNP: ref
seq: G: mut seq: C: mut aa: p.A307G: mutation info source: CCLE: ref target(-10 +10):
CTTCACTAAGGCGGCTTTGGC (SEQ ID NO: 2453): mut target(-10 +10):
CTTCACTAAGCCGGCTTTGGC (SEQ ID NO: 2454): [Model Cell line information]: cell: NCIH1573:
cancer type: LUNG: PAM dist: 1: indel length: 0: CRISPR gRNA ID: GF-CCELg9-646: [crRNA sequence]:
crRNA sequence: AAGCCGGCTTTGGCACCGTTGGG (SEQ ID NO: 2459):
SpgRNA: attctaatacgactcactataggAAGCCGGCTTTGGCACCGTTgttttagagctagaaatagcaagttaaaataaggctagtccgtt
atcaacttgaaaaagtggcaccgagtcggtgc (SEQ ID NO: 2460): [Target gene information]: Gene ID: 8929: Symbol:
PHOX2B: Ensembl Transcript ID: EN5T00000226382.2: GRCh: 37: Chr: 4: [Target cancer mutation
information]: mut start: 41747849: mut end: 41747849: mut class: Missense Mutation: mut type: SNP: ref
seq: G: mut seq: C: mut aa: p.A307G: mutation info source: CCLE: ref target(-10 +10):
CTTCACTAAGGCGGCTTTGGC (SEQ ID NO: 2453): mut target(-10 +10):
CTTCACTAAGCCGGCTTTGGC (SEQ ID NO: 2454): [Model Cell line information]: cell: NCIH1573:
cancer type: LUNG: PAM dist: 17: indel length: 0: CRISPR gRNA ID: GF-CCELg9-647: [crRNA sequence]:
crRNA sequence: GGTCATGCACAAACGTTTGGAGG (SEQ ID NO: 2461):
SpgRNA: attctaatacgactcactataggGGTCATGCACAAACGTTTGGgttttagagctagaaatagcaagttaaaataaggctagtccgtt
atcaacttgaaaaagtggcaccgagtcggtgc (SEQ ID NO: 2462): [Target gene information]: Gene ID: 5288: Symbol:
PIK3C2G: Ensembl Transcript ID: EN5T00000266497.5: GRCh: 37: Chr: 12: [Target cancer mutation
information]: mut start: 18658378: mut end: 18658378: mut class: Silent: mut type: SNP: ref seq: A: mut
seq: G: mut aa: p.T1061T: mutation info source: CCLE: ref target(-10 +10):

татЬLE 7-continued

Illustrative guide RNA sequences for polypeptides comprising Cas9

ATGCACAAACATTTGGAGGGA (SEQ ID NO: 679): mut target(-10 +10):
ATGCACAAACGTTTGGAGGGA (SEQ ID NO: 680): [Model Cell line information]: cell: NCIH1573:
cancer type: LUNG: PAM dist: 6: indel length: 0: CRISPR gRNA ID: GF-CCELg9-648: [crRNA sequence]:
crRNA sequence: AAACGTTTGGAGGGATAAAAAGG (SEQ ID NO: 2463):
SpgRNA: attctaatacgactcactataggAAACGTTTGGAGGGATAAAGttttagagctagaaatagcaagttaaaataaggctagtccgt
tatcaacttgaaaaagtggcaccgagtcggtgc (SEQ ID NO: 2464): [Target gene information]: Gene ID: 5288: Symbol:
PIK3C2G: Ensembl Transcript ID: EN5T00000266497.5: GRCh: 37: Chr: 12: [Target cancer mutation
information]: mut start: 18658378: mut end: 18658378: mut class: Silent: mut type: SNP: ref seq: A: mut
seq: G: mut aa: p.T1061T: mutation info source: CCLE: ref target(-10 +10):
ATGCACAAACATTTGGAGGGA (SEQ ID NO: 679): mut target(-10 +10):
ATGCACAAACGTTTGGAGGGA (SEQ ID NO: 680): [Model Cell line information]: cell: NCIH1573:
cancer type: LUNG: PAM dist: 16: indel length: 0: CRISPR gRNA ID: GF-CCELg9-649: [crRNA sequence]:
crRNA sequence: TTAGGTCATGCACAAACGTTTGG (SEQ ID NO: 2465):
SpgRNA: attctaatacgactcactataggTTAGGTCATGCACAAACGTTgttttagagctagaaatagcaagttaaaataaggctagtccgtt
atcaacttgaaaaagtggcaccgagtcggtgc (SEQ ID NO: 2466): [Target gene information]: Gene ID: 5288: Symbol:
PIK3C2G: Ensembl Transcript ID: EN5T00000266497.5: GRCh: 37: Chr: 12: [Target cancer mutation
information]: mut start: 18658378: mut end: 18658378: mut class: Silent: mut type: SNP: ref seq: A: mut
seq: G: mut aa: p.T1061T: mutation info source: CCLE: ref target(-10 +10):
ATGCACAAACATTTGGAGGGA (SEQ ID NO: 679): mut target(-10 +10):
ATGCACAAACGTTTGGAGGGA (SEQ ID NO: 680): [Model Cell line information]: cell: NCIH1573:
cancer type: LUNG: PAM dist: 3: indel length: 0: CRISPR gRNA ID: GF-CCELg9-650: [crRNA sequence]:
crRNA sequence: GTCATGCACAAACGTTTGGAGGG (SEQ ID NO: 2467):
SpgRNA: attctaatacgactcactataggGtCATGCACAAACGTTTGGAGGGttttagagctagaaatagcaagttaaaataaggctagtccgtt
atcaacttgaaaaagtggcaccgagtcggtgc (SEQ ID NO: 2468): [Target gene information]: Gene ID: 5288: Symbol:
PIK3C2G: Ensembl Transcript ID: EN5T00000266497.5: GRCh: 37: Chr: 12: [Target cancer mutation
information]: mut start: 18658378: mut end: 18658378: mut class: Silent: mut type: SNP: ref seq: A: mut
seq: G: mut aa: p.T1061T: mutation info source: CCLE: ref target(-10 +10):
ATGCACAAACATTTGGAGGGA (SEQ ID NO: 679): mut target(-10 +10):
ATGCACAAACGTTTGGAGGGA (SEQ ID NO: 680): [Model Cell line information]: cell: NCIH1573:
cancer type: LUNG: PAM dist: 7: indel length: 0: CRISPR gRNA ID: GF-CCELg9-651: [crRNA sequence]:
crRNA sequence: TAAATTCTGCAGAAATAGTTAGG (SEQ ID NO: 2469):
SpgRNA: attctaatacgactcactataggTAAATTCTGCAGAAATAGTTAGGgttttagagctagaaatagcaagttaaaataaggctagtccgtt
atcaacttgaaaaagtggcaccgagtcggtgc (SEQ ID NO: 2470): [Target gene information]: Gene ID: 5289: Symbol:
PIK3C3: Ensembl Transcript ID: EN5T00000262039.4: GRCh: 37: Chr: 18: [Target cancer mutation
information]: mut start: 39593557: mut end: 39593557: mut class: Missense Mutation: mut type: SNP: ref
seq: A: mut seq: T: mut aa: p.D441V: mutation info source: CCLE: ref target(-10 +10):
GCAGAAATAGATAGGTATGGA (SEQ ID NO: 2471): mut target(-10 +10):
GCAGAAATAGTTAGGTATGGA (SEQ ID NO: 2472): [Model Cell line information]: cell: NCIH1573:
cancer type: LUNG: PAM dist: 2: indel length: 0: CRISPR gRNA ID: GF-CCELg9-652: [crRNA sequence]:
crRNA sequence: ATAGTTAGGTATGGATATCCAGG (SEQ ID NO: 2473):
SpgRNA: attctaatacgactcactataggATAGTTAGGTATGGATATCCgttttagagctagaaatagcaagttaaaataaggctagtccgtt
atcaacttgaaaaagtggcaccgagtcggtgc (SEQ ID NO: 2474): [Target gene information]: Gene ID: 5289: Symbol:
PIK3C3: Ensembl Transcript ID: EN5T00000262039.4: GRCh: 37: Chr: 18: [Target cancer mutation
information]: mut start: 39593557: mut end: 39593557: mut class: Missense Mutation: mut type: SNP: ref
seq: A: mut seq: T: mut aa: p.D441V: mutation info source: CCLE: ref target(-10 +10):
GCAGAAATAGATAGGTATGGA (SEQ ID NO: 2471): mut target(-10 +10):
GCAGAAATAGTTAGGTATGGA (SEQ ID NO: 2472): [Model Cell line information]: cell: NCIH1573:
cancer type: LUNG: PAM dist: 16: indel length: 0: CRISPR gRNA ID: GF-CCELg9-653: [crRNA sequence]:
crRNA sequence: TTAGGTATGGATATCCAGGGAGG (SEQ ID NO: 2475):
SpgRNA: attctaatacgactcactataggTTAGGTATGGATATCCAGGGttttagagctagaaatagcaagttaaaataaggctagtccgtt
atcaacttgaaaaagtggcaccgagtcggtgc (SEQ ID NO: 2476): [Target gene information]: Gene ID: 5289: Symbol:
PIK3C3: Ensembl Transcript ID: EN5T00000262039.4: GRCh: 37: Chr: 18: [Target cancer mutation
information]: mut start: 39593557: mut end: 39593557: mut class: Missense Mutation: mut type: SNP: ref
seq: A: mut seq: T: mut aa: p.D441V: mutation info source: CCLE: ref target(-10 +10):
GCAGAAATAGATAGGTATGGA (SEQ ID NO: 2471): mut target(-10 +10):
GCAGAAATAGTTAGGTATGGA (SEQ ID NO: 2472): [Model Cell line information]: cell: NCIH1573:
cancer type: LUNG: PAM dist: 20: indel length: 0: CRISPR gRNA ID: GF-CCELg9-654: [crRNA sequence]:
crRNA sequence: TCTGCAGAAATAGTTAGGTATGG (SEQ ID NO: 2477):
SpgRNA: attctaatacgactcactataggTCTGCAGAAATAGTTAGGTAgOitagagctagaaatagcaagttaaaataaggctagtccgtt
atcaacttgaaaaagtggcaccgagtcggtgc (SEQ ID NO: 2478): [Target gene information]: Gene ID: 5289: Symbol:
PIK3C3: Ensembl Transcript ID: EN5T00000262039.4: GRCh: 37: Chr: 18: [Target cancer mutation
information]: mut start: 39593557: mut end: 39593557: mut class: Missense Mutation: mut type: SNP: ref
seq: A: mut seq: T: mut aa: p.D441V: mutation info source: CCLE: ref target(-10 +10):
GCAGAAATAGATAGGTATGGA (SEQ ID NO: 2471): mut target(-10 +10):
GCAGAAATAGTTAGGTATGGA (SEQ ID NO: 2472): [Model Cell line information]: cell: NCIH1573:
cancer type: LUNG: PAM dist: 7: indel length: 0: CRISPR gRNA ID: GF-CCELg9-655: [crRNA sequence]:
crRNA sequence: TAGTTAGGTATGGATATCCAGGG (SEQ ID NO: 2479):
SpgRNA: attctaatacgactcactataggTAGTTAGGTATGGATATCCAgOitagagctagaaatagcaagttaaaataaggctagtccgtt
atcaacttgaaaaagtggcaccgagtcggtgc (SEQ ID NO: 2480): [Target gene information]: Gene ID: 5289: Symbol:
PIK3C3: Ensembl Transcript ID: EN5T00000262039.4: GRCh: 37: Chr: 18: [Target cancer mutation
information]: mut start: 39593557: mut end: 39593557: mut class: Missense Mutation: mut type: SNP: ref
seq: A: mut seq: T: mut aa: p.D441V: mutation info source: CCLE: ref target(-10 +10):
GCAGAAATAGATAGGTATGGA (SEQ ID NO: 2471): mut target(-10 +10):
GCAGAAATAGTTAGGTATGGA (SEQ ID NO: 2472): [Model Cell line information]: cell: NCIH1573:
cancer type: LUNG: PAM dist: 17: indel length: 0: CRISPR gRNA ID: GF-CCELg9-656: [crRNA sequence]:
crRNA sequence: GAATGTAACCCTTAAATGTGAGG (SEQ ID NO: 2481):
SpgRNA: attctaatacgactcactataggGAATGTAACCCTTAAATGTGgttttagagctagaaatagcaagttaaaataaggctagtccgtt
atcaacttgaaaaagtggcaccgagtcggtgc (SEQ ID NO: 2482): [Target gene information]: Gene ID: 5289: Symbol:

TABLE 7-continued

Illustrative guide RNA sequences for polypeptides comprising Cas9

PIK3C3: Ensembl Transcript ID: EN5T00000262039.4: GRCh: 37: Chr: 18: [Target cancer mutation
information]: mut start: 39607512: mut end: 39607512: mut class: Splice Site: mut type: SNP: ref seq: G:
mut seq: T: mut aa: p.K530N: mutation info source: CCLE: ref target(-10 +10):
CATTGTTGAAGGTAACCCTTA (SEQ ID NO: 687): mut target(-10 +10):
CATTGTTGAATGTAACCCTTA (SEQ ID NO: 688): [Model Cell line information]: cell: NCIH1573:
cancer type: LUNG: PAM dist: 17: indel length: 0: CRISPR gRNA ID: GF-CCELg9-657: [crRNA sequence]:
crRNA sequence: AATGTAACCCTTAAATGTGAGGG (SEQ ID NO: 2483):
SpgRNA: attctaatacgactcactataggAATGTAACCCTTAAATGTGAg0itagagctagaaatagcaagttaaaataaggctagtccgtt
atcaacttgaaaaagtggcaccgagtcggtgc (SEQ ID NO: 2484): [Target gene information]: Gene ID: 5289: Symbol:
PIK3C3: Ensembl Transcript ID: EN5T00000262039.4: GRCh: 37: Chr: 18: [Target cancer mutation
information]: mut start: 39607512: mut end: 39607512: mut class: Splice Site: mut type: SNP: ref seq: G:
mut seq: T: mut aa: p.K530N: mutation info source: CCLE: ref target(-10 +10):
CATTGTTGAAGGTAACCCTTA (SEQ ID NO: 687): mut target(-10 +10):
CATTGTTGAATGTAACCCTTA (SEQ ID NO: 688): [Model Cell line information]: cell: NCIH1573:
cancer type: LUNG: PAM dist: 18: indel length: 0: CRISPR gRNA ID: GF-CCELg9-658: [crRNA sequence]:
crRNA sequence: GGGTTACATTCAACAATGCTTGG (SEQ ID NO: 2485):
SpgRNA: attctaatacgactcactataggGGGTTACATTCAACAATGCTgttttagagctagaaatagcaagttaaaataaggctagtccgtt
atcaacttgaaaaagtggcaccgagtcggtgc (SEQ ID NO: 2486): [Target gene information]: Gene ID: 5289: Symbol:
PIK3C3: Ensembl Transcript ID: EN5T00000262039.4: GRCh: 37: Chr: 18: [Target cancer mutation
information]: mut start: 39607512: mut end: 39607512: mut class: Splice Site: mut type: SNP: ref seq: G:
mut seq: T: mut aa: p.K530N: mutation info source: CCLE: ref target(-10 +10):
CATTGTTGAAGGTAACCCTTA (SEQ ID NO: 687): mut target(-10 +10):
CATTGTTGAATGTAACCCTTA (SEQ ID NO: 688): [Model Cell line information]: cell: NCIH1573:
cancer type: LUNG: PAM dist: 13: indel length: 0: CRISPR gRNA ID: GF-CCELg9-659: [crRNA sequence]:
crRNA sequence: TTTATTAAAGATTTTGCTATCGG (SEQ ID NO: 2487):
SpgRNA: attctaatacgactcactataggTTTATTAAAGATTTTGCTATgttttagagctagaaatagcaagttaaaataaggctagtccgtta
tcaacttgaaaaagtggcaccgagtcggtgc (SEQ ID NO: 2488): [Target gene information]: Gene ID: 5290: Symbol:
PIK3CA: Ensembl Transcript ID: EN5T00000263967.3: GRCh: 37: Chr: 3: [Target cancer mutation
informa-
tion]: mut start: 178917478: mut end: 178917478: mut class: Splice Site: mut type: SNP: ref seq: G:
mut seq: A: mut aa: p.G118D: mutation info source: CCLE: ref target(-10 +10):
TTTATTAAAGGTTTTGCTATC (SEQ ID NO: 691): mut target(-10 +10):
TTTATTAAAGATTTTGCTATC (SEQ ID NO: 692): [Model Cell line information]: cell: NCIH1975:
cancer type: LUNG: PAM dist: 10: indel length: 0: CRISPR gRNA ID: GF-CCELg9-660: [crRNA sequence]:
crRNA sequence: TCTCTCTGAAATCACTAAGCAGG (SEQ ID NO: 2489):
SpgRNA: attctaatacgactcactataggTCTCTCTGAAATCACTAAGCgttttagagctagaaatagcaagttaaaataaggctagtccgtt
atcaacttgaaaaagtggcaccgagtcggtgc (SEQ ID NO: 2490): [Target gene information]: Gene ID: 5290: Symbol:
PIK3CA: Ensembl Transcript ID: EN5T00000263967.3: GRCh: 37: Chr: 3: [Target cancer mutation
information]: mut start: 178936091: mut end: 178936091: mut class: Missense Mutation: mut type: SNP: ref
seq: G: mut seq: A: mut aa: p.E545K: mutation info source: CCLE: ref target(-10 +10):
TGAAATCACTGAGCAGGAGAA (SEQ ID NO: 699): mut target(-10 +10):
TGAAATCACTAAGCAGGAGAA (SEQ ID NO: 700): [Model Cell line information]: cell: NCIH460:
cancer type: LUNG: PAM dist: 4: indel length: 0: CRISPR gRNA ID: GF-CCELg9-661: [crRNA sequence]:
crRNA sequence: TGCTTAGTGATTTCAGAGAGAGG (SEQ ID NO: 2491):
SpgRNA: attctaatacgactcactataggTGCTTAGTGATTTCAGAGAGgttttagagctagaaatagcaagttaaaataaggctagtccgtt
atcaacttgaaaaagtggcaccgagtcggtgc (SEQ ID NO: 2492): [Target gene information]: Gene ID: 5290: Symbol:
PIK3CA: Ensembl Transcript ID: EN5T00000263967.3: GRCh: 37: Chr: 3: [Target cancer mutation
information]: mut start: 178936091: mut end: 178936091: mut class: Missense Mutation: mut type: SNP: ref
seq: G: mut seq: A: mut aa: p.E545K: mutation info source: CCLE: ref target(-10 +10):
TGAAATCACTGAGCAGGAGAA (SEQ ID NO: 699): mut target(-10 +10):
TGAAATCACTAAGCAGGAGAA (SEQ ID NO: 700): [Model Cell line information]: cell: NCIH460:
cancer type: LUNG: PAM dist: 16: indel length: 0: CRISPR gRNA ID: GF-CCELg9-662: [crRNA sequence]:
crRNA sequence: TCTCTCTAAAATCACTGAGCAGG (SEQ ID NO: 2493):
SpgRNA: attctaatacgactcactataggTCTCTCTAAAATCACTGAGCgttttagagctagaaatagcaagttaaaataaggctagtccgtt
atcaacttgaaaaagtggcaccgagtcggtgc (SEQ ID NO: 2494): [Target gene information]: Gene ID: 5290: Symbol:
PIK3CA: Ensembl Transcript ID: EN5T00000263967.3: GRCh: 37: Chr: 3: [Target cancer mutation
information]: mut start: 178936082: mut end: 178936082: mut class: Missense Mutation: mut type: SNP: ref
seq: G: mut seq: A: mut aa: p.E542K: mutation info source: CCLE: ref target(-10 +10):
TCCTCTCTCTGAAATCACTGA (SEQ ID NO: 703): mut target(-10 +10):
TCCTCTCTCTAAAATCACTGA (SEQ ID NO: 704): [Model Cell line information]: cell: NCIH1563:
cancer type: LUNG: PAM dist: 13: indel length: 0: CRISPR gRNA ID: GF-CCELg9-663: [crRNA sequence]:
crRNA sequence: TGCTCAGTGATTTTAGAGAGG (SEQ ID NO: 2495):
SpgRNA: attctaatacgactcactataggTGCTCAGTGATTTTAGAGAGgttttagagctagaaatagcaagttaaaataaggctagtccgtt
atcaacttgaaaaagtggcaccgagtcggtgc (SEQ ID NO: 2496): [Target gene information]: Gene ID: 5290: Symbol:
PIK3CA: Ensembl Transcript ID: EN5T00000263967.3: GRCh: 37: Chr: 3: [Target cancer mutation
information]: mut start: 178936082: mut end: 178936082: mut class: Missense Mutation: mut type: SNP: ref
seq: G: mut seq: A: mut aa: p.E542K: mutation info source: CCLE: ref target(-10 +10):
TCCTCTCTCTGAAATCACTGA (SEQ ID NO: 703): mut target(-10 +10):
TCCTCTCTCTAAAATCACTGA (SEQ ID NO: 704): [Model Cell line information]: cell: NCIH1563:
cancer type: LUNG: PAM dist: 7: indel length: 0: CRISPR gRNA ID: GF-CCELg9-664: [crRNA sequence]:
crRNA sequence: TGAACTTACGTAGAATATATTGG (SEQ ID NO: 2497):
SpgRNA: attctaatacgactcactataggTGAACTTACGTAGAATATATgttttagagctagaaatagcaagttaaaataaggctagtccgtt
atcaacttgaaaaagtggcaccgagtcggtgc (SEQ ID NO: 2498): [Target gene information]: Gene ID: 5295: Symbol:
PIK3R1: Ensembl Transcript ID: EN5T00000521381.1: GRCh: 37: Chr: 5: [Target cancer mutation
information]: mut start: 67522714: mut end: 67522714: mut class: Nonsense Mutation: mut type: SNP: ref
seq: G: mut seq: T: mut aa: p.G71*: mutation info source: CCLE: ref target(-10 +10):
GGACTTTCCGGGAACTTACGT (SEQ ID NO: 713): mut target(-10 +10):
GGACTTTCCGTGAACTTACGT (SEQ ID NO: 714): [Model Cell line information]: cell: NCIH1573:

TABLE 7-continued

Illustrative guide RNA sequences for polypeptides comprising Cas9 cancer type: LUNG: PAM dist: 20: indel length: 0: CRISPR gRNA ID: GF-CCELg9-665: [crRNA sequence]:
crRNA sequence: ATATATTCTACGTAAGTTCACGG (SEQ ID NO: 2499):
SpgRNA: attctaatacgactcactataggATATATTCTACGTAAGTTCAgttttagagctagaaatagcaagttaaaataaggctagtccgtt
atcaacttgaaaaagtggcaccgagtcggtgc (SEQ ID NO: 2500): [Target gene information]: Gene ID: 5295: Symbol:
PIK3R1: Ensembl Transcript ID: EN5T00000521381.1: GRCh: 37: Chr: 5: [Target cancer mutation
information]: mut start: 67522714: mut end: 67522714: mut class: Nonsense Mutation: mut type: SNP: ref
seq: G: mut seq: T: mut aa: p.G71*: mutation info source: CCLE: ref target(-10 +10):
GGACTTTCCGGGAACTTACGT (SEQ ID NO: 713): mut target(-10 +10):
GGACTTTCCGTGAACTTACGT (SEQ ID NO: 714): [Model Cell line information]: cell: NCIH1573:
cancer type: LUNG: PAM dist: 1: indel length: 0: CRISPR gRNA ID: GF-CCELg9-666: [crRNA sequence]:
crRNA sequence: AATGATCGATGTTCACGTTTTGG (SEQ ID NO: 2501):
SpgRNA: attctaatacgactcactataggAATGATCGATGTTCACGTTTgttttagagctagaaatagcaagttaaaataaggctagtccgtt
atcaacttgaaaaagtggcaccgagtcggtgc (SEQ ID NO: 2502): [Target gene information]: Gene ID: 5295: Symbol:
PIK3R1: Ensembl Transcript ID: EN5T00000521381.1: GRCh: 37: Chr: 5: [Target cancer mutation
information]: mut start: 67575464: mut end: 67575464: mut class: Silent: mut type: SNP: ref seq: G: mut
seq: T: mut aa: p.V179V: mutation info source: CCLE: ref target(-10 +10):
TGATCGATGTGCACGTTTTGG (SEQ ID NO: 717): mut target(-10 +10):
TGATCGATGTTCACGTTTTGG (SEQ ID NO: 718): [Model Cell line information]: cell: NCIH1573:
cancer type: LUNG: PAM dist: 8: indel length: 0: CRISPR gRNA ID: GF-CCELg9-667: [crRNA sequence]:
crRNA sequence: TTTTCTCATCATAATGGGCCAGG (SEQ ID NO: 2503):
SpgRNA: attctaatacgactcactataggTTTTCTCATCATAATGGGCCgttttagagctagaaatagcaagttaaaataaggctagtccgtta
tcaacttgaaaaagtggcaccgagtcggtgc (SEQ ID NO: 2504): [Target gene information]: Gene ID: 8503: Symbol:
PIK3R3: Ensembl Transcript ID: EN5T00000262741.5: GRCh: 37: Chr: 1: [Target cancer mutation
information]: mut start: 46511726: mut end: 46511726: mut class: Missense Mutation: mut type: SNP: ref
seq: G: mut seq: C: mut aa: p.P351A: mutation info source: CCLE: ref target(-10 +10):
TCATAATGGGGCAGGTTTTCA (SEQ ID NO: 721): mut target(-10 +10):
TCATAATGGGCCAGGTTTTCA (SEQ ID NO: 722): [Model Cell line information]: cell: NCIH661:
cancer type: LUNG: PAM dist: 2: indel length: 0: CRISPR gRNA ID: GF-CCELg9-668: [crRNA sequence]:
crRNA sequence: TTTTGCAAAGCTACCCTGAAAGG (SEQ ID NO: 2505):
SpgRNA: attctaatacgactcactataggTTTTGCAAAGCTACCCTGAAgttttagagctagaaatagcaagttaaaataaggctagtccgtt
atcaacttgaaaaagtggcaccgagtcggtgc (SEQ ID NO: 2506): [Target gene information]: Gene ID: 10769:
Symbol: PLK2: Ensembl Transcript ID: EN5T00000274289.3: GRCh: 37: Chr: 5: [Target cancer mutation
information]: mut start: 57754916: mut end: 57754916: mut class: Missense Mutation: mut type: SNP: ref
seq: C: mut seq: T: mut aa: p.G925: mutation info source: CCLE: ref target(-10 +10):
TTTGCAAAGCCACCCTGAAAG (SEQ ID NO: 729): mut target(-10 +10):
TTTGCAAAGCTACCCTGAAAG (SEQ ID NO: 730): [Model Cell line information]: cell: NCIH2126:
cancer type: LUNG: PAM dist: 9: indel length: 0: CRISPR gRNA ID: GF-CCELg9-669: [crRNA sequence]:
crRNA sequence: GGCGATGTCCCTGGGGCGGGAGG (SEQ ID NO: 2507):
SpgRNA: attctaatacgactcactataggGGCGATGTCCCTGGGGCGGGgttttagagctagaaatagcaagttaaaataaggctagtccgt
tatcaacttgaaaaagtggcaccgagtcggtgc (SEQ ID NO: 2508): [Target gene information]: Gene ID: 5424: Symbol:
POLD1: Ensembl Transcript ID: EN5T00000440232.2: GRCh: 37: Chr: 19: [Target cancer mutation
information]: mut start: 50917065: mut end: 50917065: mut class: Missense Mutation: mut type: SNP: ref
seq: G: mut seq: T: mut aa: p.A773S: mutation info source: CCLE: ref target(-10 +10):
TGAGGCGATGGCCCTGGGGCG (SEQ ID NO: 2509): mut target(-10 +10):
TGAGGCGATGTCCCTGGGGCG (SEQ ID NO: 2510): [Model Cell line information]: cell: A549: cancer
type: LUNG: PAM dist: 13: indel length: 0: CRISPR gRNA ID: GF-CCELg9-670: [crRNA sequence]:
crRNA sequence: GGTGGCTGAGGCGATGTCCCTGG (SEQ ID NO: 2511):
SpgRNA: attctaatacgactcactataggGGTGGCTGAGGCGATGTCCCgttttagagctagaaatagcaagttaaaataaggctagtccgtg
atcaacttgaaaaagtggcaccgagtcggtgc (SEQ ID NO: 2512): [Target gene information]: Gene ID: 5424: Symbol:
POLD1: Ensembl Transcript ID: EN5T00000440232.2: GRCh: 37: Chr: 19: [Target cancer mutation
information]: mut start: 50917065: mut end: 50917065: mut class: Missense Mutation: mut type: SNP: ref
seq: G: mut seq: T: mut aa: p.A773S: mutation info source: CCLE: ref target(-10 +10):
TGAGGCGATGGCCCTGGGGCG (SEQ ID NO: 2509): mut target(-10 +10):
TGAGGCGATGTCCCTGGGGCG (SEQ ID NO: 2510): [Model Cell line information]: cell: A549: cancer
type: LUNG: PAM dist: 4: indel length: 0: CRISPR gRNA ID: GF-CCELg9-671: [crRNA sequence]: crRNA
sequence: CTGAGGCGATGTCCCTGGGCGG (SEQ ID NO: 2513):
SpgRNA: attctaatacgactcactataggCTGAGGCGATGTCCCTGGGGgttttagagctagaaatagcaagttaaaataaggctagtccgtt
atcaacttgaaaaagtggcaccgagtcggtgc (SEQ ID NO: 2514): [Target gene information]: Gene ID: 5424: Symbol:
POLD1: Ensembl Transcript ID: EN5T00000440232.2: GRCh: 37: Chr: 19: [Target cancer mutation
information]: mut start: 50917065: mut end: 50917065: mut class: Missense Mutation: mut type: SNP: ref
seq: G: mut seq: T: mut aa: p.A773S: mutation info source: CCLE: ref target(-10 +10):
TGAGGCGATGGCCCTGGGGCG (SEQ ID NO: 2509): mut target(-10 +10):
TGAGGCGATGTCCCTGGGGCG (SEQ ID NO: 2510): [Model Cell line information]: cell: A549: cancer
type: LUNG: PAM dist: 9: indel length: 0: CRISPR gRNA ID: GF-CCELg9-672: [crRNA sequence]: crRNA
sequence: GTCCCTGGGGCGGGAGGCCGCGG (SEQ ID NO: 2515):
SpgRNA: attctaatacgactcactataggGTCCCTGGGGCGGGAGGCCGgttttagagctagaaatagcaagttaaaataaggctagtccgt
tatcaacttgaaaaagtggcaccgagtcggtgc (SEQ ID NO: 2516): [Target gene information]: Gene ID: 5424: Symbol:
POLD1: Ensembl Transcript ID: ENST00000440232.2: GRCh: 37: Chr: 19: [Target cancer mutation
information]: mut start: 50917065: mut end: 50917065: mut class: Missense Mutation: mut type: SNP: ref
seq: G: mut seq: T: mut aa: p.A773S: mutation info source: CCLE: ref target(-10 +10):
TGAGGCGATGGCCCTGGGGCG (SEQ ID NO: 2509): mut target(-10 +10):
TGAGGCGATGTCCCTGGGGCG (SEQ ID NO: 2510): [Model Cell line information]: cell: A549: cancer
type: LUNG: PAM dist: 19: indel length: 0: CRISPR gRNA ID: GF-CCELg9-673: [crRNA sequence]:
crRNA sequence: GTGGCTGAGGCGATGTCCCTGGG (SEQ ID NO: 2517):
SpgRNA: attctaatacgactcactataggGTGGCTGAGGCGATGTCCCTgttttagagctagaaatagcaagttaaaataaggctagtccgtt
atcaacttgaaaaagtggcaccgagtcggtgc (SEQ ID NO: 2518): [Target gene information]: Gene ID: 5424: Symbol:
POLD1: Ensembl Transcript ID: EN5T00000440232.2: GRCh: 37: Chr: 19: [Target cancer mutation
information]: mut start: 50917065: mut end: 50917065: mut class: Missense Mutation: mut type: SNP: ref TABLE 7-continued Illustrative guide RNA sequences for polypeptides comprising Cas9 seq: G: mut seq: T: mut aa: p.A7735: mutation info source: CCLE: ref target(-10 +10):
TGAGGCGATGGCCCTGGGGCG (SEQ ID NO: 2509): mut target(-10 +10):
TGAGGCGATGTCCCTGGGGCG (SEQ ID NO: 2510): [Model Cell line information]: cell: A549: cancer
type: LUNG: PAM dist: 5: indel length: 0: CRISPR gRNA ID: GF-CCELg9-674: [crRNA sequence]: crRNA
sequence: TGGCTGAGGCGATGTCCCTGGGG (SEQ ID NO: 2519):
SpgRNA: attctaatacgactcactataggTGGCTGAGGCGATGTCCCTGgttttagagctagaaatagcaagttaaaataaggctagtccgtt
atcaacttgaaaaagtggcaccgagtcggtgc (SEQ ID NO: 2520): [Target gene information]: Gene ID: 5424: Symbol:
POLD1: Ensembl Transcript ID: EN5T00000440232.2: GRCh: 37: Chr: 19: [Target cancer mutation
information]: mut start: 50917065: mut end: 50917065: mut class: Missense Mutation: mut type: SNP: ref
seq: G: mut seq: T: mut aa: p.A7735: mutation info source: CCLE: ref target(-10 +10):
TGAGGCGATGGCCCTGGGGCG (SEQ ID NO: 2509): mut target(-10 +10):
TGAGGCGATGTCCCTGGGGCG (SEQ ID NO: 2510): [Model Cell line information]: cell: A549: cancer
type: LUNG: PAM dist: 6: indel length: 0: CRISPR gRNA ID: GF-CCELg9-675: [crRNA sequence]: crRNA
sequence: TGAGGCGATGTCCCTGGGGCGGG (SEQ ID NO: 2521):
SpgRNA: attctaatacgactcactataggTGAGGCGATGTCCCTGGGGCgttttagagctagaaatagcaagttaaaataaggctagtccgtt
atcaacttgaaaaagtggcaccgagtcggtgc (SEQ ID NO: 2522): [Target gene information]: Gene ID: 5424: Symbol:
POLD1: Ensembl Transcript ID: EN5T00000440232.2: GRCh: 37: Chr: 19: [Target cancer mutation
information]: mut start: 50917065: mut end: 50917065: mut class: Missense Mutation: mut type: SNP: ref
seq: G: mut seq: T: mut aa: p.A773S: mutation source: CCLE: ref target(-10 +10):
TGAGGCGATGGCCCTGGGGCG (SEQ ID NO: 2509): mut target(-10 +10):
TGAGGCGATGTCCCTGGGGCG (SEQ ID NO: 2510): [Model Cell line information]: cell: A549: cancer
type: LUNG: PAM dist: 10: indel length: 0: CRISPR gRNA ID: GF-CCELg9-676: [crRNA sequence]:
crRNA sequence: GGACATCGCCTCAGCCACCGAGG (SEQ ID NO: 2523):
SpgRNA: attctaatacgactcactataggGGACATCGCCTCAGCCACCGgttttagagctagaaatagcaagttaaaataaggctagtccgtt
atcaacttgaaaaagtggcaccgagtcggtgc (SEQ ID NO: 2524): [Target gene information]: Gene ID: 5424: Symbol:
POLD1: Ensembl Transcript ID: EN5T00000440232.2: GRCh: 37: Chr: 19: [Target cancer mutation
information]: mut start: 50917065: mut end: 50917065: mut class: Missense Mutation: mut type: SNP: ref
seq: G: mut seq: T: mut aa: p.A7735: mutation info source: CCLE: ref target(-10 +10):
TGAGGCGATGGCCCTGGGGCG (SEQ ID NO: 2509): mut target(-10 +10):
TGAGGCGATGTCCCTGGGGCG (SEQ ID NO: 2510): [Model Cell line information]: cell: A549: cancer
type: LUNG: PAM dist: 18: indel length: 0: CRISPR gRNA ID: GF-CCELg9-677: [crRNA sequence]:
crRNA sequence: GGGCAAGGTGGGCGGCCTCTTGG (SEQ ID NO: 2525):
SpgRNA: attctaatacgactcactataggGGGCAAGGTGGGCGGCCTCTgttttagagctagaaatagcaagttaaaataaggctagtccgt
tatcaacttgaaaaagtggcaccgagtcggtgc (SEQ ID NO: 2526): [Target gene information]: Gene ID: 5424: Symbol:
POLD1: Ensembl Transcript ID: EN5T00000440232.2: GRCh: 37: Chr: 19: [Target cancer mutation
information]: mut start: 50919920: mut end: 50919920: mut class: Silent: mut type: SNP: ref seq: C: mut
seq: T: mut aa: p.L1003L: mutation info source: CCLE: ref target(-10 +10):
GGGCGGCCTCCTGGCCTTCGC (SEQ ID NO: 741): mut target(-10 +10):
GGGCGGCCTCTTGGCCTTCGC (SEQ ID NO: 742): [Model Cell line information]: cell: A549: cancer
type: LUNG: PAM dist: 1: indel length: 0: CRISPR gRNA ID: GF-CCELg9-678: [crRNA sequence]: crRNA
sequence: GGCGTTTGGCGAAGGCCAAGAGG (SEQ ID NO: 2527):
SpgRNA: attctaatacgactcactataggGGCGTTTGGCGAAGGCCAAGgttttagagctagaaatagcaagttaaaataaggctagtccgt
tatcaacttgaaaaagtggcaccgagtcggtgc (SEQ ID NO: 2528): [Target gene information]: Gene ID: 5424: Symbol:
POLD1: Ensembl Transcript ID: EN5T00000440232.2: GRCh: 37: Chr: 19: [Target cancer mutation
information]: mut start: 50919920: mut end: 50919920: mut class: Silent: mut type: SNP: ref seq: C: mut
seq: T: mut aa: p.L1003L: mutation info source: CCLE: ref target(-10 +10):
GGGCGGCCTCCTGGCCTTCGC (SEQ ID NO: 741): mut target(-10 +10):
GGGCGGCCTCTTGGCCTTCGC (SEQ ID NO: 742): [Model Cell line information]: cell: A549: cancer
type: LUNG: PAM dist: 2: indel length: 0: CRISPR gRNA ID: GF-CCELg9-679: [crRNA sequence]: crRNA
sequence: GACGCAGTGCCAGCGCTGCTAGG (SEQ ID NO: 2529):
SpgRNA: attctaatacgactcactataggGACGCAGTGCCAGCGCTGCTgttttagagctagaaatagcaagttaaaataaggctagtccgtt
atcaacttgaaaaagtggcaccgagtcggtgc (SEQ ID NO: 253 0): [Target gene information]: Gene ID: 5424: Symbol:
POLD1: Ensembl Transcript ID: EN5T00000440232.2: GRCh: 37: Chr: 19: [Target cancer mutation
information]: mut start: 50920492: mut end: 50920492: mut class: Nonsense Mutation: mut type: SNP: ref
seq: C: mut seq: T: mut aa: p.Q1062*: mutation info source: CCLE: ref target(-10 +10):
CCAGCGCTGCCAGGGCAGCCT (SEQ ID NO: 2531): mut target(-10 +10):
CCAGCGCTGCTAGGGCAGCCT (SEQ ID NO: 2532): [Model Cell line information]: cell: A549: cancer
type: LUNG: PAM dist: 1: indel length: 0: CRISPR gRNA ID: GF-CCELg9-680: [crRNA sequence]: crRNA
sequence: CTGCTAGGGCAGCCTGCACGAGG (SEQ ID NO: 2533):
SpgRNA: attctaatacgactcactataggCTGCTAGGGCAGCCTGCACGgttttagagctagaaatagcaagttaaaataaggctagtccgtt
atcaacttgaaaaagtggcaccgagtcggtgc (SEQ ID NO: 253 4): [Target gene information]: Gene ID: 5424: Symbol:
POLD1: Ensembl Transcript ID: EN5T00000440232.2: GRCh: 37: Chr: 19: [Target cancer mutation
information]: mut start: 50920492: mut end: 50920492: mut class: Nonsense Mutation: mut type: SNP: ref
seq: C: mut seq: T: mut aa: p.Q1062*: mutation info source: CCLE: ref target(-10 +10):
CCAGCGCTGCCAGGGCAGCCT (SEQ ID NO: 2531): mut target(-10 +10):
CCAGCGCTGCTAGGGCAGCCT (SEQ ID NO: 2532): [Model Cell line information]: cell: A549: cancer
type: LUNG: PAM dist: 16: indel length: 0: CRISPR gRNA ID: GF-CCELg9-681: [crRNA sequence]:
crRNA sequence: ACGCAGTGCCAGCGCTGCTAGGG (SEQ ID NO: 2535):
SpgRNA: attctaatacgactcactataggACGCAGTGCCAGCGCTGCTAgttttagagctagaaatagcaagttaaaataaggctagtccgtt
atcaacttgaaaaagtggcaccgagtcggtgc (SEQ ID NO: 253 6): [Target gene information]: Gene ID: 5424: Symbol:
POLD1: Ensembl Transcript ID: EN5T00000440232.2: GRCh: 37: Chr: 19: [Target cancer mutation
information]: mut start: 50920492: mut end: 50920492: mut class: Nonsense Mutation: mut type: SNP: ref
seq: C: mut seq: T: mut aa: p.Q1062*: mutation info source: CCLE: ref target(-10 +10):
CCAGCGCTGCCAGGGCAGCCT (SEQ ID NO: 2531): mut target(-10 +10):
CCAGCGCTGCTAGGGCAGCCT (SEQ ID NO: 2532): [Model Cell line information]: cell: A549: cancer
type: LUNG: PAM dist: 2: indel length: 0: CRISPR gRNA ID: GF-CCELg9-682: [crRNA sequence]: crRNA
sequence: GCAGGCTGCCCTAGCAGCGCTGG (SEQ ID NO: 2537):

TABLE 7-continued

Illustrative guide RNA sequences for polypeptides comprising Cas9

SpgRNA: attctaatacgactcactataggGCAGGCTGCCCTAGCAGCGCgttttagagctagaaatagcaagttaaaataaggctagtccgtt
atcaacttgaaaaagtggcaccgagtcggtgc (SEQ ID NO: 253 8): [Target gene information]: Gene ID: 5424: Symbol:
POLD1: Ensembl Transcript ID: EN5T00000440232.2: GRCh: 37: Chr: 19: [Target cancer mutation
information]: mut start: 50920492: mut end: 50920492: mut class: Nonsense Mutation: mut type: SNP: ref
seq: C: mut seq: T: mut aa: p.Q1062*: mutation info source: CCLE: ref target(-10 +10):
CCAGCGCTGCCAGGGCAGCCT (SEQ ID NO: 2531): mut target(-10 +10):
CCAGCGCTGCTAGGGCAGCCT (SEQ ID NO: 2532): [Model Cell line information]: cell: A549: cancer
type: LUNG: PAM dist: 8: indel length: 0: CRISPR gRNA ID: GF-CCELg9-683: [crRNA sequence]: crRNA
sequence: GCCCCTCATCTTTCAACAGTTGG (SEQ ID NO: 2539):
SpgRNA: attctaatacgactcactataggGCCCCTCATCTTTCAACAGTgttttagagctagaaatagcaagttaaaataaggctagtccgtta
tcaacttgaaaaagtggcaccgagtcggtgc (SEQ ID NO: 2540): [Target gene information]: Gene ID: 5424: Symbol:
POLD1: Ensembl Transcript ID: EN5T00000440232.2: GRCh: 37: Chr: 19: [Target cancer mutation
information]: mut start: 50902713: mut end: 50902713: mut class: Silent: mut type: SNP: ref seq: C: mut
seq: T: mut aa: p.F96F: mutation info source: CCLE: ref target(-10 +10): CCCTCATCTTCCAACAGTTGG
(SEQ ID NO: 745): mut target(-10 +10): CCCTCATCTTTCAACAGTTGG (SEQ ID NO: 746): [Model
Cell line information]: cell: NCIH1563: cancer type: LUNG: PAM dist: 8: indel length: 0: CRISPR gRNA
ID: GF-CCELg9-684: [crRNA sequence]: crRNA sequence: TCTCCAACTGTTGAAAGATGAGG (SEQ ID
NO: 2541):
SpgRNA: attctaatacgactcactataggTCTCCAACTGTTGAAAGATGgttttagagctagaaatagcaagttaaaataaggctagtccgtt
atcaacttgaaaaagtggcaccgagtcggtgc (SEQ ID NO: 2542): [Target gene information]: Gene ID: 5424: Symbol:
POLD1: Ensembl Transcript ID: EN5T00000440232.2: GRCh: 37: Chr: 19: [Target cancer mutation
information]: mut start: 50902713: mut end: 50902713: mut class: Silent: mut type: SNP: ref seq: C: mut
seq: T: mut aa: p.F96F: mutation info source: CCLE: ref target(-10 +10): CCCTCATCTTCCAACAGTTGG
(SEQ ID NO: 745): mut target(-10 +10): CCCTCATCTTTCAACAGTTGG (SEQ ID NO: 746): [Model
Cell line information]: cell: NCIH1563: cancer type: LUNG: PAM dist: 7: indel length: 0: CRISPR gRNA
ID: GF-CCELg9-685: [crRNA sequence]: crRNA sequence: GAAAGATGAGGGGCTCTGTCTGG (SEQ ID
NO: 2543):
SpgRNA: attctaatacgactcactataggGAAAGATGAGGGGCTCTGTCgttttagagctagaaatagcaagttaaaataaggctagtccgt
tatcaacttgaaaaagtggcaccgagtcggtgc (SEQ ID NO: 2544): [Target gene information]: Gene ID: 5424: Symbol:
POLD1: Ensembl Transcript ID: EN5T00000440232.2: GRCh: 37: Chr: 19: [Target cancer mutation
information]: mut start: 50902713: mut end: 50902713: mut class: Silent: mut type: SNP: ref seq: C: mut
seq: T: mut aa: p.F96F: mutation info source: CCLE: ref target(-10 +10): CCCTCATCTTCCAACAGTTGG
(SEQ ID NO: 745): mut target(-10 +10): CCCTCATCTTTCAACAGTTGG (SEQ ID NO: 746): [Model
Cell line information]: cell: NCIH1563: cancer type: LUNG: PAM dist: 19: indel length: 0: CRISPR gRNA
ID: GF-CCELg9-686: [crRNA sequence]: crRNA sequence: CTCCAACTGTTGAAAGATGAGGG (SEQ ID
NO: 2545):
SpgRNA: attctaatacgactcactataggCTCCAACTGTTGAAAGATGAgttttagagctagaaatagcaagttaaaataaggctagtccgtt
atcaacttgaaaaagtggcaccgagtcggtgc (SEQ ID NO: 2546): [Target gene information]: Gene ID: 5424: Symbol:
POLD1: Ensembl Transcript ID: EN5T00000440232.2: GRCh: 37: Chr: 19: [Target cancer mutation
information]: mut start: 50902713: mut end: 50902713: mut class: Silent: mut type: SNP: ref seq: C: mut
seq: T: mut aa: p.F96F: mutation info source: CCLE: ref target(-10 +10): CCCTCATCTTCCAACAGTTGG
(SEQ ID NO: 745): mut target(-10 +10): CCCTCATCTTTCAACAGTTGG (SEQ ID NO: 746): [Model
Cell line information]: cell: NCIH1563: cancer type: LUNG: PAM dist: 8: indel length: 0: CRISPR gRNA
ID: GF-CCELg9-687: [crRNA sequence]: crRNA sequence: TCCAACTGTTGAAAGATGAGGGG (SEQ ID
NO: 2547):
SpgRNA: attctaatacgactcactataggTCCAACTGTTGAAAGATGAGgttttagagctagaaatagcaagttaaaataaggctagtccgtt
atcaacttgaaaaagtggcaccgagtcggtgc (SEQ ID NO: 2548): [Target gene information]: Gene ID: 5424: Symbol:
POLD1: Ensembl Transcript ID: EN5T00000440232.2: GRCh: 37: Chr: 19: [Target cancer mutation
information]: mut start: 50902713: mut end: 50902713: mut class: Silent: mut type: SNP: ref seq: C: mut
seq: T: mut aa: p.F96F: mutation info source: CCLE: ref target(-10 +10): CCCTCATCTTCCAACAGTTGG
(SEQ ID NO: 745): mut target(-10 +10): CCCTCATCTTTCAACAGTTGG (SEQ ID NO: 746): [Model
Cell line information]: cell: NCIH1563: cancer type: LUNG: PAM dist: 9: indel length: 0: CRISPR gRNA
ID: GF-CCELg9-688: [crRNA sequence]: crRNA sequence: AAAGATGAGGGGCTCTGTCTGGG (SEQ ID
NO: 2549):
SpgRNA: attctaatacgactcactataggAAAGATGAGGGGCTCTGTCTg agagctagaaatagcaagttaaaataaggctagtccgtt
atcaacttgaaaaagtggcaccgagtcggtgc (SEQ ID NO: 2550): [Target gene information]: Gene ID: 5424: Symbol:
POLD1: Ensembl Transcript ID: EN5T00000440232.2: GRCh: 37: Chr: 19: [Target cancer mutation
information]: mut start: 50902713: mut end: 50902713: mut class: Silent: mut type: SNP: ref seq: C: mut
seq: T: mut aa: p.F96F: mutation info source: CCLE: ref target(-10 +10): CCCTCATCTTCCAACAGTTGG
(SEQ ID NO: 745): mut target(-10 +10): CCCTCATCTTTCAACAGTTGG (SEQ ID NO: 746): [Model
Cell line information]: cell: NCIH1563: cancer type: LUNG: PAM dist: 20: indel length: 0: CRISPR gRNA
ID: GF-CCELg9-689: [crRNA sequence]: crRNA sequence: CTGGTTCCAGGTAGCTGAATTGG (SEQ ID
NO: 2551):
SpgRNA: attctaatacgactcactataggCTGGTTCCAGGTAGCTGAATgttttagagctagaaatagcaagttaaaataaggctagtccgtt
atcaacttgaaaaagtggcaccgagtcggtgc (SEQ ID NO: 2552): [Target gene information]: Gene ID: 5426: Symbol:
POLE: Ensembl Transcript ID: EN5T00000320574.5: GRCh: 37: Chr: 12: [Target cancer mutation
information]: mut start: 133220012: mut end: 133220012: mut class: Silent: mut type: SNP: ref seq: C: mut
seq: T: mut aa: p.Q1475Q: mutation info source: CCLE: ref target(-10 +10):
GGTAGCTGAACTGGGCCAGAG (SEQ ID NO: 2553): mut target(-10 +10):
GGTAGCTGAATTGGGCCAGAG (SEQ ID NO: 2554): [Model Cell line information]: cell: A549: cancer
type: LUNG: PAM dist: 1: indel length: 0: CRISPR gRNA ID: GF-CCELg9-690: [crRNA sequence]: crRNA
sequence: TGGTTCCAGGTAGCTGAATTGGG (SEQ ID NO: 2555):
SpgRNA: attctaatacgactcactataggTGGTTCCAGGTAGCTGAATTgttttagagctagaaatagcaagttaaaataaggctagtccgtt
atcaacttgaaaaagtggcaccgagtcggtgc (SEQ ID NO: 2556): [Target gene information]: Gene ID: 5426: Symbol:
POLE: Ensembl Transcript ID: EN5T00000320574.5: GRCh: 37: Chr: 12: [Target cancer mutation
information]: mut start: 133220012: mut end: 133220012: mut class: Silent: mut type: SNP: ref seq: C: mut
seq: T: mut aa: p.Q1475Q: mutation info source: CCLE: ref target(-10 +10):
GGTAGCTGAACTGGGCCAGAG (SEQ ID NO: 2553): mut target(-10 +10):

TABLE 7-continued

Illustrative guide RNA sequences for polypeptides comprising Cas9

GGTAGCTGAATTGGGCCAGAG (SEQ ID NO: 2554): [Model Cell line information]: cell: A549: cancer
type: LUNG: PAM dist: 2: indel length: 0: CRISPR gRNA ID: GF-CCELg9-691: [crRNA sequence]: crRNA
sequence: CAATTCAGCTACCTGGAACCAGG (SEQ ID NO: 2557):
SpgRNA: attctaatacgactcactataggCAATTCAGCTACCTGGAACCgttttagagctagaaatagcaagttaaaataaggctagtccgtt
atcaacttgaaaaagtggcaccgagtcggtgc (SEQ ID NO: 2558): [Target gene information]: Gene ID: 5426: Symbol:
POLE: Ensembl Transcript ID: EN5T00000320574.5: GRCh: 37: Chr: 12: [Target cancer mutation
information]: mut start: 133220012: mut end: 133220012: mut class: Silent: mut type: SNP: ref seq: C: mut
seq: T: mut aa: p.Q1475Q: mutation info source: CCLE: ref target(-10 +10):
GGTAGCTGAACTGGGCCAGAG (SEQ ID NO: 2553): mut target(-10 +10):
GGTAGCTGAATTGGGCCAGAG (SEQ ID NO: 2554): [Model Cell line information]: cell: A549: cancer
type: LUNG: PAM dist: 18: indel length: 0: CRISPR gRNA ID: GF-CCELg9-692: [crRNA sequence]:
crRNA sequence: TCTGGCCCAATTCAGCTACCTGG (SEQ ID NO: 2559):
SpgRNA: attctaatacgactcactataggTCTGGCCCAATTCAGCTACCgttttagagctagaaatagcaagttaaaataaggctagtccgtt
atcaacttgaaaaagtggcaccgagtcggtgc (SEQ ID NO: 2560): [Target gene information]: Gene ID: 5426: Symbol:
POLE: Ensembl Transcript ID: EN5T00000320574.5: GRCh: 37: Chr: 12: [Target cancer mutation
information]: mut start: 133220012: mut end: 133220012: mut class: Silent: mut type: SNP: ref seq: C: mut
seq: T: mut aa: p.Q1475Q: mutation info source: CCLE: ref target(-10 +10):
GGTAGCTGAACTGGGCCAGAG (SEQ ID NO: 2553): mut target(-10 +10):
GGTAGCTGAATTGGGCCAGAG (SEQ ID NO: 2554): [Model Cell line information]: cell: A549: cancer
type: LUNG: PAM dist: 11: indel length: 0: CRISPR gRNA ID: GF-CCELg9-693: [crRNA sequence]:
crRNA sequence: GGAACTTCTCTGACTCCACCTGG (SEQ ID NO: 2561):
SpgRNA: attctaatacgactcactataggGGAACTTCTCTGACTCCACCgttttagagctagaaatagcaagttaaaataaggctagtccgtt
atcaacttgaaaaagtggcaccgagtcggtgc (SEQ ID NO: 2562): [Target gene information]: Gene ID: 5426: Symbol:
POLE: Ensembl Transcript ID: EN5T00000320574.5: GRCh: 37: Chr: 12: [Target cancer mutation
information]: mut start: 133245047: mut end: 133245047: mut class: Missense Mutation: mut type: SNP: ref
seq: G: mut seq: C: mut aa: p.L690V: mutation info source: CCLE: ref target(-10 +10):
TCTGACTCCAGCTGGTGCTGG (SEQ ID NO: 2563): mut target(-10 +10):
TCTGACTCCACCTGGTGCTGG (SEQ ID NO: 2564): [Model Cell line information]: cell: HPAFII:
cancer type: PANCREAS: PAM dist: 2: indel length: 0: CRISPR gRNA ID: GF-CCELg9-694: [crRNA
sequence]: crRNA sequence: TCTCTGACTCCACCTGGTGCTGG (SEQ ID NO: 2565):
SpgRNA: attctaatacgactcactataggTCTCTGACTCCACCTGGTGCgttttagagctagaaatagcaagttaaaataaggctagtccgtta
tcaacttgaaaaagtggcaccgagtcggtgc (SEQ ID NO: 2566): [Target gene information]: Gene ID: 5426: Symbol:
POLE: Ensembl Transcript ID: EN5T00000320574.5: GRCh: 37: Chr: 12: [Target cancer mutation
information]: mut start: 133245047: mut end: 133245047: mut class: Missense Mutation: mut type: SNP: ref
seq: G: mut seq: C: mut aa: p.L690V: mutation info source: CCLE: ref target(-10 +10):
TCTGACTCCAGCTGGTGCTGG (SEQ ID NO: 2563): mut target(-10 +10):
TCTGACTCCACCTGGTGCTGG (SEQ ID NO: 2564): [Model Cell line information]: cell: HPAFII:
cancer type: PANCREAS: PAM dist: 8: indel length: 0: CRISPR gRNA ID: GF-CCELg9-695: [crRNA
sequence]: crRNA sequence: CCACCTGGTGCTGGATCCGATGG (SEQ ID NO: 2567):
SpgRNA: attctaatacgactcactataggCCACCTGGTGCTGGATCCGAgttttagagctagaaatagcaagttaaaataaggctagtccgtt
atcaacttgaaaaagtggcaccgagtcggtgc (SEQ ID NO: 2568): [Target gene information]: Gene ID: 5426: Symbol:
POLE: Ensembl Transcript ID: EN5T00000320574.5: GRCh: 37: Chr: 12: [Target cancer mutation
information]: mut start: 133245047: mut end: 133245047: mut class: Missense Mutation: mut type: SNP: ref
seq: G: mut seq: C: mut aa: p.L690V: mutation info source: CCLE: ref target(-10 +10):
TCTGACTCCAGCTGGTGCTGG (SEQ ID NO: 2563): mut target(-10 +10):
TCTGACTCCACCTGGTGCTGG (SEQ ID NO: 2564): [Model Cell line information]: cell: HPAFII:
cancer type: PANCREAS: PAM dist: 17: indel length: 0: CRISPR gRNA ID: GF-CCELg9-696: [crRNA
sequence]: crRNA sequence: CCATCGGATCCAGCACCAGGTGG (SEQ ID NO: 2569):
SpgRNA: attctaatacgactcactataggCCATCGGATCCAGCACCAGGgttttagagctagaaatagcaagttaaaataaggctagtccgtt
atcaacttgaaaaagtggcaccgagtcggtgc (SEQ ID NO: 2570): [Target gene information]: Gene ID: 5426: Symbol:
POLE: Ensembl Transcript ID: EN5T00000320574.5: GRCh: 37: Chr: 12: [Target cancer mutation
information]: mut start: 133245047: mut end: 133245047: mut class: Missense Mutation: mut type: SNP: ref
seq: G: mut seq: C: mut aa: p.L690V: mutation info source: CCLE: ref target(-10 +10):
TCTGACTCCAGCTGGTGCTGG (SEQ ID NO: 2563): mut target(-10 +10):
TCTGACTCCACCTGGTGCTGG (SEQ ID NO: 2564): [Model Cell line information]: cell: HPAFII:
cancer type: PANCREAS: PAM dist: 1: indel length: 0: CRISPR gRNA ID: GF-CCELg9-697: [crRNA
sequence]: crRNA sequence: AGCGGCAGGGGGCTCGGAACTGG (SEQ ID NO: 2571):
SpgRNA: attctaatacgactcactataggAGCGGCAGGGGGCTCGGAACgttttagagctagaaatagcaagttaaaataaggctagtccgt
tatcaacttgaaaaagtggcaccgagtcggtgc (SEQ ID NO: 2572): [Target gene information]: Gene ID: 5426: Symbol:
POLE: Ensembl Transcript ID: EN5T00000320574.5: GRCh: 37: Chr: 12: [Target cancer mutation
information]: mut start: 133202797: mut end: 133202797: mut class: Missense Mutation: mut type: SNP: ref
seq: T: mut seq: G: mut aa: p.D2146A: mutation info source: CCLE: ref target(-10 +10):
GCGGCAGGGGTCTCGGAACTG (SEQ ID NO: 2573): mut target(-10 +10):
GCGGCAGGGGGCTCGGAACTG (SEQ ID NO: 2574): [Model Cell line information]: cell: NCIH1437:
cancer type: LUNG: PAM dist: 9: indel length: 0: CRISPR gRNA ID: GF-CCELg9-698: [crRNA sequence]:
crRNA sequence: CGTAGGAGCGGCAGGGGGCTCGG (SEQ ID NO: 2575):
SpgRNA: attctaatacgactcactataggCGTAGGAGCGGCAGGGGGCTgttttagagctagaaatagcaagttaaaataaggctagtccgt
tatcaacttgaaaaagtggcaccgagtcggtgc (SEQ ID NO: 2576): [Target gene information]: Gene ID: 5426: Symbol:
POLE: Ensembl Transcript ID: ENST00000320574.5: GRCh: 37: Chr: 12: [Target cancer mutation
information]: mut start: 133202797: mut end: 133202797: mut class: Missense Mutation: mut type: SNP: ref
seq: T: mut seq: G: mut aa: p.D2146A: mutation info source: CCLE: ref target(-10 +10):
GCGGCAGGGGTCTCGGAACTG (SEQ ID NO: 2573): mut target(-10 +10):
GCGGCAGGGGGCTCGGAACTG (SEQ ID NO: 2574): [Model Cell line information]: cell: NCIH1437:
cancer type: LUNG: PAM dist: 3: indel length: 0: CRISPR gRNA ID: GF-CCELg9-699: [crRNA sequence]:
crRNA sequence: GGCTCGGAACTGGGCCTCCTCGG (SEQ ID NO: 2577):
SpgRNA: attctaatacgactcactataggGGCTCGGAACTGGGCCTCCTgttttagagctagaaatagcaagttaaaataaggctagtccgtt
atcaacttgaaaaagtggcaccgagtcggtgc (SEQ ID NO: 2578): [Target gene information]: Gene ID: 5426: Symbol:
POLE: Ensembl Transcript ID: EN5T00000320574.5: GRCh: 37: Chr: 12: [Target cancer mutation TABLE 7-continued Illustrative guide RNA sequences for polypeptides comprising Cas9 information]: mut start: 133202797: mut end: 133202797: mut class: Missense Mutation: mut type: SNP: ref
seq: T: mut seq: G: mut aa: p.D2146A: mutation info source: CCLE: ref target(-10 +10):
GCGGCAGGGGTCTCGGAACTG (SEQ ID NO: 2573): mut target(-10 +10):
GCGGCAGGGGGCTCGGAACTG (SEQ ID NO: 2574): [Model Cell line information]: cell: NCIH1437:
cancer type: LUNG: PAM dist: 19: indel length: 0: CRISPR gRNA ID: GF-CCELg9-700: [crRNA sequence]:
crRNA sequence: GCGGCAGGGGGCTCGGAACTGGG (SEQ ID NO: 2579):
SpgRNA: attctaatacgactcactataggGCGGCAGGGGGCTCGGAACTGgtttttagagctagaaatagcaagttaaaataaggctagtccgt
tatcaacttgaaaaagtggcaccgagtcggtgc (SEQ ID NO: 2580): [Target gene information]: Gene ID: 5426: Symbol:
POLE: Ensembl Transcript ID: EN5T00000320574.5: GRCh: 37: Chr: 12: [Target cancer mutation
information]: mut start: 133202797: mut end: 133202797: mut class: Missense Mutation: mut type: SNP: ref
seq: T: mut seq: G: mut aa: p.D2146A: mutation info source: CCLE: ref target(-10 +10):
GCGGCAGGGGTCTCGGAACTG (SEQ ID NO: 2573): mut target(-10 +10):
GCGGCAGGGGGCTCGGAACTG (SEQ ID NO: 2574): [Model Cell line information]: cell: NCIH1437:
cancer type: LUNG: PAM dist: 10: indel length: 0: CRISPR gRNA ID: GF-CCELg9-701: [crRNA sequence]:
crRNA sequence: ATGCGCCACTTCCTCAGTTTCGG (SEQ ID NO: 2581):
SpgRNA: attctaatacgactcactataggATGCGCCACTTCCTCAGTTTgttttagagctagaaatagcaagttaaaataaggctagtccgtta
tcaacttgaaaaagtggcaccgagtcggtgc (SEQ ID NO: 2582): [Target gene information]: Gene ID: 5426: Symbol:
POLE: Ensembl Transcript ID: EN5T00000320574.5: GRCh: 37: Chr: 12: [Target cancer mutation
information]: mut start: 133257857: mut end: 133257857: mut class: Frame Shift Del: mut type: DEL: ref
seq: C: mut seq: -: mut aa: p.G24fs: mutation info source: CCLE: ref target(-10 +10):
GGAAGTGGCGCCATCATCCCT (SEQ ID NO: 749): mut target(-10 +10): GGAAGTGGCG-
CATCATCCCT (SEQ ID NO: 750): [Model Cell line information]: cell: NCIH2126: cancer type: LUNG:
PAM dist: 18: indel length: 1: CRISPR gRNA ID: GF-CCELg9-702: [crRNA sequence]: crRNA sequence:
AATGGCTTAAGTCTAAGTAGTGG (SEQ ID NO: 2583):
SpgRNA: attctaatacgactcactataggAATGGCTTAAGTCTAAGTAGgliftagagctagaaatagcaagttaaaataaggctagtccgtt
atcaacttgaaaaagtggcaccgagtcggtgc (SEQ ID NO: 2584): [Target gene information]: Gene ID: 8493: Symbol:
PPM1D: Ensembl Transcript ID: EN5T00000305921.3: GRCh: 37: Chr: 17: [Target cancer mutation
information]: mut start: 58740765: mut end: 58740765: mut class: Missense Mutation: mut type: SNP: ref
seq: G: mut seq: T: mut aa: p.R557L: mutation info source: CCLE: ref target(-10 +10):
GGCTTAAGTCGAAGTAGTGGT (SEQ ID NO: 2585): mut target(-10 +10):
GGCTTAAGTCTAAGTAGTGGT (SEQ ID NO: 2586): [Model Cell line information]: cell: NCIH661:
cancer type: LUNG: PAM dist: 7: indel length: 0: CRISPR gRNA ID: GF-CCELg9-703: [crRNA sequence]:
crRNA sequence: GGGGTTCATCAAGAAGCAGAAGG (SEQ ID NO: 2587):
SpgRNA: attctaatacgactcactataggGGGGTTCATCAAGAAGCAGAgliftagagctagaaatagcaagttaaaataaggctagtccgt
tatcaacttgaaaaagtggcaccgagtcggtgc (SEQ ID NO: 2588): [Target gene information]: Gene ID: 8493: Symbol:
PPM1D: Ensembl Transcript ID: EN5T00000305921.3: GRCh: 37: Chr: 17: [Target cancer mutation
information]: mut start: 58678141: mut end: 58678141: mut class: Silent: mut type: SNP: ref seq: T: mut
seq: G: mut aa: p.G122G: mutation info source: CCLE: ref target(-10 +10):
ACTTGTGGGGTTTCATCAAGA (SEQ ID NO: 753): mut target(-10 +10):
ACTTGTGGGGGTTCATCAAGA (SEQ ID NO: 754): [Model Cell line information]: cell: HPAFII: cancer
type: PANCREAS: PAM dist: 17: indel length: 0: CRISPR gRNA ID: GF-CCELg9-704: [crRNA sequence]:
crRNA sequence: GGGGTTCATCAAGAAGCAGAAGGG (SEQ ID NO: 2589):
SpgRNA: attctaatacgactcactataggGGGGTTCATCAAGAAGCAGAAgliftagagctagaaatagcaagttaaaataaggctagtccgtt
tatcaacttgaaaaagtggcaccgagtcggtgc (SEQ ID NO: 2590): [Target gene information]: Gene ID: 8493: Symbol:
PPM1D: Ensembl Transcript ID: EN5T00000305921.3: GRCh: 37: Chr: 17: [Target cancer mutation
information]: mut start: 58678141: mut end: 58678141: mut class: Silent: mut type: SNP: ref seq: T: mut
seq: G: mut aa: p.G122G: mutation info source: CCLE: ref target(-10 +10):
ACTTGTGGGGTTTCATCAAGA (SEQ ID NO: 753): mut target(-10 +10):
ACTTGTGGGGGTTCATCAAGA (SEQ ID NO: 754): [Model Cell line information]: cell: HPAFII: cancer
type: PANCREAS: PAM dist: 18: indel length: 0: CRISPR gRNA ID: GF-CCELg9-705: [crRNA sequence]:
crRNA sequence: TGAACCCCCACAAGTGCTCCCGG (SEQ ID NO: 2591):
SpgRNA: attctaatacgactcactataggTGAACCCCCACAAGTGCTCCggttttagagctagaaatagcaagttaaaataaggctagtccgtt
atcaacttgaaaaagtggcaccgagtcggtgc (SEQ ID NO: 2592): [Target gene information]: Gene ID: 8493: Symbol:
PPM1D: Ensembl Transcript ID: EN5T00000305921.3: GRCh: 37: Chr: 17: [Target cancer mutation
information]: mut start: 58678141: mut end: 58678141: mut class: Silent: mut type: SNP: ref seq: T: mut
seq: G: mut aa: p.G122G: mutation info source: CCLE: ref target(-10 +10):
ACTTGTGGGGTTTCATCAAGA (SEQ ID NO: 753): mut target(-10 +10):
ACTTGTGGGGGTTCATCAAGA (SEQ ID NO: 754): [Model Cell line information]: cell: HPAFII: cancer
type: PANCREAS: PAM dist: 16: indel length: 0: CRISPR gRNA ID: GF-CCELg9-706: [crRNA sequence]:
crRNA sequence: GAACCCCCACAAGTGCTCCCGGG (SEQ ID NO: 2593):
SpgRNA: attctaatacgactcactataggGAACCCCCACAAGTGCTCCCggttttagagctagaaatagcaagttaaaataaggctagtccgtt
atcaacttgaaaaagtggcaccgagtcggtgc (SEQ ID NO: 2594): [Target gene information]: Gene ID: 8493: Symbol:
PPM1D: Ensembl Transcript ID: EN5T00000305921.3: GRCh: 37: Chr: 17: [Target cancer mutation
information]: mut start: 58678141: mut end: 58678141: mut class: Silent: mut type: SNP: ref seq: T: mut
seq: G: mut aa: p.G122G: mutation info source: CCLE: ref target(-10 +10):
ACTTGTGGGGTTTCATCAAGA (SEQ ID NO: 753): mut target(-10 +10):
ACTTGTGGGGGTTCATCAAGA (SEQ ID NO: 754): [Model Cell line information]: cell: HPAFII: cancer
type: PANCREAS: PAM dist: 17: indel length: 0: CRISPR gRNA ID: GF-CCELg9-707: [crRNA sequence]:
crRNA sequence: TGATGAAGATGATGTCCTCCTGG (SEQ ID NO: 2595):
SpgRNA: attctaatacgactcactataggTGATGAAGATGATGTCCTCCgttttagagctagaaatagcaagttaaaataaggctagtccgtt
atcaacttgaaaaagtggcaccgagtcggtgc (SEQ ID NO: 2596): [Target gene information]: Gene ID: 5518: Symbol:
PPP2R1A: Ensembl Transcript ID: EN5T00000322088.6: GRCh: 37: Chr: 19: [Target cancer mutation
information]: mut start: 52709238: mut end: 52709238: mut class: Missense Mutation: mut type: SNP: ref
seq: G: mut seq: T: mut aa: p.E64D: mutation info source: CCLE: ref target(-10 +10):
ATGAAGATGAGGTCCTCCTGG (SEQ ID NO: 2597): mut target(-10 +10):
ATGAAGATGATGTCCTCCTGG (SEQ ID NO: 2598): [Model Cell line information]: cell: NCIH460:
cancer type: LUNG: PAM dist: 8: indel length: 0: CRISPR gRNA ID: GF-CCELg9-708: [crRNA sequence]:
crRNA sequence: AGATGATGTCCTCCTGGCCCTGG (SEQ ID NO: 2599):

TABLE 7-continued

Illustrative guide RNA sequences for polypeptides comprising Cas9

SpgRNA: attctaatacgactcactataggAGATGATGTCCTCCTGGCCCgttttagagctagaaatagcaagttaaaataaggctagtccgtt
atcaacttgaaaaagtggcaccgagtcggtgc (SEQ ID NO: 2600): [Target gene information]: Gene ID: 5518: Symbol:
PPP2R1A: Ensembl Transcript ID: EN5T00000322088.6: GRCh: 37: Chr: 19: [Target cancer mutation
information]: mut start: 52709238: mut end: 52709238: mut class: Missense Mutation: mut type: SNP: ref
seq: G: mut seq: T: mut aa: p.E64D: mutation info source: CCLE: ref target(-10 +10):
ATGAAGATGAGGTCCTCCTGG (SEQ ID NO: 2597): mut target(-10 +10):
ATGAAGATGATGTCCTCCTGG (SEQ ID NO: 2598): [Model Cell line information]: cell: NCIH460:
cancer type: LUNG: PAM dist: 14: indel length: 0: CRISPR gRNA ID: GF-CCELg9-709: [crRNA sequence]:
crRNA sequence: GACATCATCTTCATCATAGATGG (SEQ ID NO: 2601):
SpgRNA: attctaatacgactcactataggGACATCATCTTCATCATAGAgttttagagctagaaatagcaagttaaaataaggctagtccgtt
atcaacttgaaaaagtggcaccgagtcggtgc (SEQ ID NO: 2602): [Target gene information]: Gene ID: 5518: Symbol:
PPP2R1A: Ensembl Transcript ID: EN5T00000322088.6: GRCh: 37: Chr: 19: [Target cancer mutation
information]: mut start: 52709238: mut end: 52709238: mut class: Missense Mutation: mut type: SNP: ref
seq: G: mut seq: T: mut aa: p.E64D: mutation info source: CCLE: ref target(-10 +10):
ATGAAGATGAGGTCCTCCTGG (SEQ ID NO: 2597): mut target(-10 +10):
ATGAAGATGATGTCCTCCTGG (SEQ ID NO: 2598): [Model Cell line information]: cell: NCIH460:
cancer type: LUNG: PAM dist: 17: indel length: 0: CRISPR gRNA ID: GF-CCELg9-710: [crRNA sequence]:
crRNA sequence: GGGAGTTGCAATGGAAAACCAGG (SEQ ID NO: 2603):
SpgRNA: attctaatacgactcactataggGGGAGTTGCAATGGAAAACCAGgttttagagctagaaatagcaagttaaaataaggctagtccgt
tatcaacttgaaaaagtggcaccgagtcggtgc (SEQ ID NO: 2604): [Target gene information]: Gene ID: 5071: Symbol:
PARK2: Ensembl Transcript ID: EN5T00000366898.1: GRCh: 37: Chr: 6: [Target cancer mutation
information]: mut start: 162206919: mut end: 162206919: mut class: Missense Mutation: mut type: SNP: ref
seq: C: mut seq: A: mut aa: p.Q252H: mutation info source: CCLE: ref target(-10 +10):
GGGAGTTGCACTGGAAAACCA (SEQ ID NO: 757): mut target(-10 +10):
GGGAGTTGCAATGGAAAACCA (SEQ ID NO: 758): [Model Cell line information]: cell: NCIH1975:
cancer type: LUNG: PAM dist: 10: indel length: 0: CRISPR gRNA ID: GF-CCELg9-711: [crRNA sequence]:
crRNA sequence: TCACGTGGCGGGAGTTGCAATGG (SEQ ID NO: 2605):
SpgRNA: attctaatacgactcactataggTCACGTGGCGGGAGTTGCAAgttttagagctagaaatagcaagttaaaataaggctagtccgtt
atcaacttgaaaaagtggcaccgagtcggtgc (SEQ ID NO: 2606): [Target gene information]: Gene ID: 5071: Symbol:
PARK2: Ensembl Transcript ID: EN5T00000366898.1: GRCh: 37: Chr: 6: [Target cancer mutation
information]: mut start: 162206919: mut end: 162206919: mut class: Missense Mutation: mut type: SNP: ref
seq: C: mut seq: A: mut aa: p.Q252H: mutation info source: CCLE: ref target(-10 +10):
GGGAGTTGCACTGGAAAACCA (SEQ ID NO: 757): mut target(-10 +10):
GGGAGTTGCAATGGAAAACCA (SEQ ID NO: 758): [Model Cell line information]: cell: NCIH1975:
cancer type: LUNG: PAM dist: 1: indel length: 0: CRISPR gRNA ID: GF-CCELg9-712: [crRNA sequence]:
crRNA sequence: GTTGCAATGGAAAACCAGGACGG (SEQ ID NO: 2607):
Sn g RNA. attctaatacgactcactataggGTTGCA A TGGA A A A CC A GGA g agagctagaaatagcaagttaaaataaggctagtccgt
tatcaacttgaaaaagtggcaccgagtcggtgc (SEQ ID NO: 2608): [Target gene information]: Gene ID: 5071: Symbol:
PARK2: Ensembl Transcript ID: ENST00000366898.1: GRCh: 37: Chr: 6: [Target cancer mutation
information]: mut start: 162206919: mut end: 162206919: mut class: Missense Mutation: mut type: SNP: ref
seq: C: mut seq: A: mut aa: p.Q252H: mutation info source: CCLE: ref target(-10 +10):
GGGAGTTGCACTGGAAAACCA (SEQ ID NO: 757): mut target(-10 +10):
GGGAGTTGCAATGGAAAACCA (SEQ ID NO: 758): [Model Cell line information]: cell: NCIH1975:
cancer type: LUNG: PAM dist: 14: indel length: 0: CRISPR gRNA ID: GF-CCELg9-713: [crRNA sequence]:
crRNA sequence: TTGCAATGGAAAACCAGGACGGG (SEQ ID NO: 2609):
SpgRNA: attctaatacgactcactataggTTGCAATGGAAAACCAGGACgttttagagctagaaatagcaagttaaaataaggctagtccgt
tatcaacttgaaaaagtggcaccgagtcggtgc (SEQ ID NO: 2610): [Target gene information]: Gene ID: 5071: Symbol:
PARK2: Ensembl Transcript ID: EN5T00000366898.1: GRCh: 37: Chr: 6: [Target cancer mutation
information]: mut start: 162206919: mut end: 162206919: mut class: Missense Mutation: mut type: SNP: ref
seq: C: mut seq: A: mut aa: p.Q252H: mutation info source: CCLE: ref target(-10 +10):
GGGAGTTGCACTGGAAAACCA (SEQ ID NO: 757): mut target(-10 +10):
GGGAGTTGCAATGGAAAACCA (SEQ ID NO: 758): [Model Cell line information]: cell: NCIH1975:
cancer type: LUNG: PAM dist: 15: indel length: 0: CRISPR gRNA ID: GF-CCELg9-714: [crRNA sequence]:
crRNA sequence: TGCAATGGAAAACCAGGACGGGG (SEQ ID NO: 2611):
SpgRNA: attctaatacgactcactataggTGCAATGGAAAACCAGGACGgttttagagctagaaatagcaagttaaaataaggctagtccgtt
atcaacttgaaaaagtggcaccgagtcggtgc (SEQ ID NO: 2612): [Target gene information]: Gene ID: 5071: Symbol:
PARK2: Ensembl Transcript ID: EN5T00000366898.1: GRCh: 37: Chr: 6: [Target cancer mutation
information]: mut start: 162206919: mut end: 162206919: mut class: Missense Mutation: mut type: SNP: ref
seq: C: mut seq: A: mut aa: p.Q252H: mutation info source: CCLE: ref target(-10 +10):
GGGAGTTGCACTGGAAAACCA (SEQ ID NO: 757): mut target(-10 +10):
GGGAGTTGCAATGGAAAACCA (SEQ ID NO: 758): [Model Cell line information]: cell: NCIH1975:
cancer type: LUNG: PAM dist: 16: indel length: 0: CRISPR gRNA ID: GF-CCELg9-715: [crRNA sequence]:
crRNA sequence: GGAGGTGGTTGCTATGCGACAGG (SEQ ID NO: 2613):
SpgRNA: attctaatacgactcactataggGGAGGTGGTTGCTATGCGACgttttagagctagaaatagcaagttaaaataaggctagtccgtt
atcaacttgaaaaagtggcaccgagtcggtgc (SEQ ID NO: 2614): [Target gene information]: Gene ID: 5071: Symbol:
PARK2: Ensembl Transcript ID: EN5T00000366898.1: GRCh: 37: Chr: 6: [Target cancer mutation
information]: mut start: 162864418: mut end: 162864418: mut class: Missense Mutation: mut type: SNP: ref
seq: T: mut seq: A: mut aa: p.K32M: mutation info source: CCLE: ref target(-10 +10):
CCCCTGTCGCTTAGCAACCAC (SEQ ID NO: 2615): mut target(-10 +10):
CCCCTGTCGCATAGCAACCAC (SEQ ID NO: 2616): [Model Cell line information]: cell: NCIH460:
cancer type: LUNG: PAM dist: 6: indel length: 0: CRISPR gRNA ID: GF-CCELg9-716: [crRNA sequence]:
crRNA sequence: TGCTATGCGACAGGGGGTTCCGG (SEQ ID NO: 2617):
SpgRNA: attctaatacgactcactataggTGCTATGCGACAGGGGGTTCgttttagagctagaaatagcaagttaaaataaggctagtccgtt
atcaacttgaaaaagtggcaccgagtcggtgc (SEQ ID NO: 2618): [Target gene information]: Gene ID: 5071: Symbol:
PARK2: Ensembl Transcript ID: EN5T00000366898.1: GRCh: 37: Chr: 6: [Target cancer mutation
information]: mut start: 162864418: mut end: 162864418: mut class: Missense Mutation: mut type: SNP: ref
seq: T: mut seq: A: mut aa: p.K32M: mutation info source: CCLE: ref target(-10 +10):
CCCCTGTCGCTTAGCAACCAC (SEQ ID NO: 2615): mut target(-10 +10):

TABLE 7-continued

Illustrative guide RNA sequences for polypeptides comprising Cas9

CCCCTGTCGCATAGCAACCAC (SEQ ID NO: 2616): [Model Cell line information]: cell: NCIH460: cancer type: LUNG: PAM dist: 15: indel length: 0: CRISPR gRNA ID: GF-CCELg9-717: [crRNA sequence]: crRNA sequence: GAGGTGGTTGCTATGCGACAGGG (SEQ ID NO: 2619):
SpgRNA: attctaatacgactcactataggGAGGTGGTTGCTATGCGACAgttttagagctagaaatagcaagttaaaataaggctagtccgtt atcaacttgaaaaagtggcaccgagtcggtgc (SEQ ID NO: 2620): [Target gene information]: Gene ID: 5071: Symbol: PARK2: Ensembl Transcript ID: EN5T00000366898.1: GRCh: 37: Chr: 6: [Target cancer mutation information]: mut start: 162864418: mut end: 162864418: mut class: Missense Mutation: mut type: SNP: ref seq: T: mut seq: A: mut aa: p.K32M: mutation info source: CCLE: ref target(-10 +10):
CCCCTGTCGCTTAGCAACCAC (SEQ ID NO: 2615): mut target(-10 +10):
CCCCTGTCGCATAGCAACCAC (SEQ ID NO: 2616): [Model Cell line information]: cell: NCIH460: cancer type: LUNG: PAM dist: 7: indel length: 0: CRISPR gRNA ID: GF-CCELg9-718: [crRNA sequence]: crRNA sequence: AGGTGGTTGCTATGCGACAGGGG (SEQ ID NO: 2621):
SpgRNA: attctaatacgactcactataggAGGTGGTTGCTATGCGACAGGttttagagctagaaatagcaagttaaaataaggctagtccgtt atcaacttgaaaaagtggcaccgagtcggtgc (SEQ ID NO: 2622): [Target gene information]: Gene ID: 5071: Symbol: PARK2: Ensembl Transcript ID: EN5T00000366898.1: GRCh: 37: Chr: 6: [Target cancer mutation information]: mut start: 162864418: mut end: 162864418: mut class: Missense Mutation: mut type: SNP: ref seq: T: mut seq: A: mut aa: p.K32M: mutation info source: CCLE: ref target(-10 +10):
CCCCTGTCGCTTAGCAACCAC (SEQ ID NO: 2615): mut target(-10 +10):
CCCCTGTCGCATAGCAACCAC (SEQ ID NO: 2616): [Model Cell line information]: cell: NCIH460: cancer type: LUNG: PAM dist: 8: indel length: 0: CRISPR gRNA ID: GF-CCELg9-719: [crRNA sequence]: crRNA sequence: GGTGGTTGCTATGCGACAGGGGG (SEQ ID NO: 2623):
SpgRNA: attctaatacgactcactataggGGTGGTTGCTATGCGACAGGgttttagagctagaaatagcaagttaaaataaggctagtccgtt atcaacttgaaaaagtggcaccgagtcggtgc (SEQ ID NO: 2624): [Target gene information]: Gene ID: 5071: Symbol: PARK2: Ensembl Transcript ID: EN5T00000366898.1: GRCh: 37: Chr: 6: [Target cancer mutation information]: mut start: 162864418: mut end: 162864418: mut class: Missense Mutation: mut type: SNP: ref seq: T: mut seq: A: mut aa: p.K32M: mutation info source: CCLE: ref target(-10 +10):
CCCCTGTCGCTTAGCAACCAC (SEQ ID NO: 2615): mut target(-10 +10):
CCCCTGTCGCATAGCAACCAC (SEQ ID NO: 2616): [Model Cell line information]: cell: NCIH460: cancer type: LUNG: PAM dist: 9: indel length: 0: CRISPR gRNA ID: GF-CCELg9-720: [crRNA sequence]: crRNA sequence: CACTTTGTTTGAATTTTTGTTGG (SEQ ID NO: 2625):
SpgRNA: attctaatacgactcactataggCACTTTGTTTGAATTTTTGTgttttagagctagaaatagcaagttaaaataaggctagtccgttat caacttgaaaaagtggcaccgagtcggtgc (SEQ ID NO: 2626): [Target gene information]: Gene ID: 5727: Symbol: PTCH1: Ensembl Transcript ID: ENST00000331920.6: GRCh: 37: Chr: 9: [Target cancer mutation information]: mut start: 98242676: mut end: 98242676: mut class: Missense Mutation: mut type: SNP: ref seq: G: mut seq: T: mut aa: p.T314N: mutation info source: CCLE: ref target(-10 +10):
ACTCACTTTGGTTGAATTTTT (SEQ ID NO: 763): mut target(-10 +10):
ACTCACTTTGTTTGAATTTTT (SEQ ID NO: 764): [Model Cell line information]: cell: HCC827GR5: cancer type: LUNG: PAM dist: 13: indel length: 0: CRISPR gRNA ID: GF-CCELg9-721: [crRNA sequence]: crRNA sequence: ACTTTGTTTGAATTTTTGTTGGG (SEQ ID NO: 2627):
SpgRNA: attctaatacgactcactataggACTTTGTTTGAATTTTTGTTgttttagagctagaaatagcaagttaaaataaggctagtccgttat caacttgaaaaagtggcaccgagtcggtgc (SEQ ID NO: 2628): [Target gene information]: Gene ID: 5727: Symbol: PTCH1: Ensembl Transcript ID: ENST00000331920.6: GRCh: 37: Chr: 9: [Target cancer mutation information]: mut start: 98242676: mut end: 98242676: mut class: Missense Mutation: mut type: SNP: ref seq: G: mut seq: T: mut aa: p.T314N: mutation info source: CCLE: ref target(-10 +10):
ACTCACTTTGGTTGAATTTTT (SEQ ID NO: 763): mut target(-10 +10):
ACTCACTTTGTTTGAATTTTT (SEQ ID NO: 764): [Model Cell line information]: cell: HCC827GR5: cancer type: LUNG: PAM dist: 14: indel length: 0: CRISPR gRNA ID: GF-CCELg9-722: [crRNA sequence]: crRNA sequence: CTTTGTTTGAATTTTTGTTGGGG (SEQ ID NO: 2629):
SpgRNA: attctaatacgactcactataggCTTTGTTTGAATTTTTGTTGgttttagagctagaaatagcaagttaaaataaggctagtccgttat caacttgaaaaagtggcaccgagtcggtgc (SEQ ID NO: 2630): [Target gene information]: Gene ID: 5727: Symbol: PTCH1: Ensembl Transcript ID: ENST00000331920.6: GRCh: 37: Chr: 9: [Target cancer mutation information]: mut start: 98242676: mut end: 98242676: mut class: Missense Mutation: mut type: SNP: ref seq: G: mut seq: T: mut aa: p.T314N: mutation info source: CCLE: ref target(-10 +10):
ACTCACTTTGGTTGAATTTTT (SEQ ID NO: 763): mut target(-10 +10):
ACTCACTTTGTTTGAATTTTT (SEQ ID NO: 764): [Model Cell line information]: cell: HCC827GR5: cancer type: LUNG: PAM dist: 15: indel length: 0: CRISPR gRNA ID: GF-CCELg9-723: [crRNA sequence]: crRNA sequence: TTTGTTTGAATTTTTGTTGGGGG (SEQ ID NO: 2631):
SpgRNA: attctaatacgactcactataggTTTGTTTGAATTTTTGTTGGgttttagagctagaaatagcaagttaaaataaggctagtccgttat caacttgaaaaagtggcaccgagtcggtgc (SEQ ID NO: 2632): [Target gene information]: Gene ID: 5727: Symbol: PTCH1: Ensembl Transcript ID: ENST00000331920.6: GRCh: 37: Chr: 9: [Target cancer mutation information]: mut start: 98242676: mut end: 98242676: mut class: Missense Mutation: mut type: SNP: ref seq: G: mut seq: T: mut aa: p.T314N: mutation info source: CCLE: ref target(-10 +10):
ACTCACTTTGGTTGAATTTTT (SEQ ID NO: 763): mut target(-10 +10):
ACTCACTTTGTTTGAATTTTT (SEQ ID NO: 764): [Model Cell line information]: cell: HCC827GR5: cancer type: LUNG: PAM dist: 16: indel length: 0: CRISPR gRNA ID: GF-CCELg9-724: [crRNA sequence]: crRNA sequence: CACTTTGTTTGAATTTTTGTTGG (SEQ ID NO: 2625):
SpgRNA: attctaatacgactcactataggCACTTTGTTTGAATTTTTGTgliliagagctagaaatagcaagttaaaataaggctagtccgttat caacttgaaaaagtggcaccgagtcggtgc (SEQ ID NO: 2626): [Target gene information]: Gene ID: 5727: Symbol: PTCH1: Ensembl Transcript ID: ENST00000331920.6: GRCh: 37: Chr: 9: [Target cancer mutation information]: mut start: 98242676: mut end: 98242676: mut class: Missense Mutation: mut type: SNP: ref seq: G: mut seq: T: mut aa: p.T314N: mutation info source: CCLE: ref target(-10 +10):
ACTCACTTTGGTTGAATTTTT (SEQ ID NO: 763): mut target(-10 +10):
ACTCACTTTGTTTGAATTTTT (SEQ ID NO: 764): [Model Cell line information]: cell: HCC827: cancer type: LUNG: PAM dist: 13: indel length: 0: CRISPR gRNA ID: GF-CCELg9-725: [crRNA sequence]: crRNA sequence: ACTTTGTTTGAATTTTTGTTGGG (SEQ ID NO: 2627):
SpgRNA: attctaatacgactcactataggACTTTGTTTGAATTTTTGTT gttttagagctagaaatagcaagttaaaataaggctagtccgttat caacttgaaaaagtggcaccgagtcggtgc (SEQ ID NO: 2628): [Target gene information]: Gene ID: 5727: Symbol: PTCH1: Ensembl Transcript ID: ENST00000331920.6: GRCh: 37: Chr: 9: [Target cancer mutation TABLE 7-continued Illustrative guide RNA sequences for polypeptides comprising Cas9 information]: mut start: 98242676: mut end: 98242676: mut class: Missense Mutation: mut type: SNP: ref seq: G: mut seq: T: mut aa: p.T314N: mutation info source: CCLE: ref target(-10 +10): ACTCACTTTGGTTGAATTTTT (SEQ ID NO: 763): mut target(-10 +10): ACTCACTTTGTTTGAATTTTT (SEQ ID NO: 764): [Model Cell line information]: cell: HCC827: cancer type: LUNG: PAM dist: 14: indel length: 0: CRISPR gRNA ID: GF-CCELg9-726: [crRNA sequence]: crRNA sequence: CTTTGTTTGAATTTTTGTTGGGG (SEQ ID NO: 2629):
SpgRNA: attctaatacgactcactataggCTTTGTTTGAATTTTTGTTGgttttagagctagaaatagcaagttaaaataaggctagtccgttat caacttgaaaaagtggcaccgagtcggtgc (SEQ ID NO: 2630): [Target gene information]: Gene ID: 5727: Symbol: PTCH1: Ensembl Transcript ID: ENST00000331920.6: GRCh: 37: Chr: 9: [Target cancer mutation information]: mut start: 98242676: mut end: 98242676: mut class: Missense Mutation: mut type: SNP: ref seq: G: mut seq: T: mut aa: p.T314N: mutation info source: CCLE: ref target(-10 +10): ACTCACTTTGGTTGAATTTTT (SEQ ID NO: 763): mut target(-10 +10): ACTCACTTTGTTTGAATTTTT (SEQ ID NO: 764): [Model Cell line information]: cell: HCC827: cancer type: LUNG: PAM dist: 15: indel length: 0: CRISPR gRNA ID: GF-CCELg9-727: [crRNA sequence]: crRNA sequence: TTTGTTTGAATTTTTGTTGGGGG (SEQ ID NO: 2631):
SpgRNA: attctaatacgactcactataggTTTGTTTGAATTTTTGTTGGgttttagagctagaaatagcaagttaaaataaggctagtccgttat caacttgaaaaagtggcaccgagtcggtgc (SEQ ID NO: 2632): [Target gene information]: Gene ID: 5727: Symbol: PTCH1: Ensembl Transcript ID: ENST00000331920.6: GRCh: 37: Chr: 9: [Target cancer mutation information]: mut start: 98242676: mut end: 98242676: mut class: Missense Mutation: mut type: SNP: ref seq: G: mut seq: T: mut aa: p.T314N: mutation info source: CCLE: ref target(-10 +10): ACTCACTTTGGTTGAATTTTT (SEQ ID NO: 763): mut target(-10 +10): ACTCACTTTGTTTGAATTTTT (SEQ ID NO: 764): [Model Cell line information]: cell: HCC827: cancer type: LUNG: PAM dist: 16: indel length: 0: CRISPR gRNA ID: GF-CCELg9-728: [crRNA sequence]: crRNA sequence: CCTGCGCGCTGGGCCGCCGGAGG (SEQ ID NO: 2633):
SpgRNA: attctaatacgactcactataggCCTGCGCGCTGGGCCGCCGGgttttagagctagaaatagcaagttaaaataaggctagtccgtt atcaacttgaaaaagtggcaccgagtcggtgc (SEQ ID NO: 2634): [Target gene information]: Gene ID: 5727: Symbol: PTCH1: Ensembl Transcript ID: EN5T00000375274.2: GRCh: 37: Chr: 9: [Target cancer mutation information]: mut start: 98279021: mut end: 98279021: mut class: Silent: mut type: SNP: ref seq: G: mut seq: T: mut aa: p.R28R: mutation info source: CCLE: ref target(-10 +10): TAAAAACCCCGGCGCGCTGGG (SEQ ID NO: 2635): mut target(-10 +10): TAAAAACCCCTGCGCGCTGGG (SEQ ID NO: 2636):
[Model Cell line information]: cell: NCIH2126: cancer type: LUNG: PAM dist: 18: indel length: 0: CRISPR gRNA ID: GF-CCELg9-729: [crRNA sequence]: crRNA sequence: GTGTAAAAACCCCTGCGCGCTGGG (SEQ ID NO: 2637):
SpgRNA: attctaatacgactcactataggGTGTAAAAACCCCTGCGCGCgttttagagctagaaatagcaagttaaaataaggctagtccgtt atcaacttgaaaaagtggcaccgagtcggtgc (SEQ ID NO: 2638): [Target gene information]: Gene ID: 5727: Symbol: PTCH1: Ensembl Transcript ID: EN5T00000375274.2: GRCh: 37: Chr: 9: [Target cancer mutation information]: mut start: 98279021: mut end: 98279021: mut class: Silent: mut type: SNP: ref seq: G: mut seq: T: mut aa: p.R28R: mutation info source: CCLE: ref target(-10 +10): TAAAAACCCCGGCGCGCTGGG (SEQ ID NO: 2635): mut target(-10 +10): TAAAAACCCCTGCGCGCTGGG (SEQ ID NO: 2636):
[Model Cell line information]: cell: NCIH2126: cancer type: LUNG: PAM dist: 7: indel length: 0: CRISPR gRNA ID: GF-CCELg9-730: [crRNA sequence]: crRNA sequence: ACCCCTGCGCGCTGGGCCGCCGG (SEQ ID NO: 2639):
SpgRNA: attctaatacgactcactataggACCCCTGCGCGCTGGGCCGCgttttagagctagaaatagcaagttaaaataaggctagtccgtt atcaacttgaaaaagtggcaccgagtcggtgc (SEQ ID NO: 2640): [Target gene information]: Gene ID: 5727: Symbol: PTCH1: Ensembl Transcript ID: EN5T00000375274.2: GRCh: 37: Chr: 9: [Target cancer mutation information]1: mut start: 98279021: mut end: 98279021: mut class: Silent: mut type: SNP: ref seq: G: mut seq: T: mut aa: p.R28R: mutation info source: CCLE: ref target(-10 +10): TAAAAACCCCGGCGCGCTGGG (SEQ ID NO: 2635): mut target(-10 +10): TAAAAACCCCTGCGCGCTGGG (SEQ ID NO: 2636):
[Model Cell line information]: cell: NCIH2126: cancer type: LUNG: PAM dist: 15: indel length: 0: CRISPR gRNA ID: GF-CCELg9-731: [crRNA sequence]: crRNA sequence: TGTAAAAACCCCTGCGCGCTGGG (SEQ ID NO: 2641):
SpgRNA: attctaatacgactcactataggTGTAAAAACCCCTGCGCGCTgttttagagctagaaatagcaagttaaaataaggctagtccgtt atcaacttgaaaaagtggcaccgagtcggtgc (SEQ ID NO: 2642): [Target gene information]: Gene ID: 5727: Symbol: PTCH1: Ensembl Transcript ID: EN5T00000375274.2: GRCh: 37: Chr: 9: [Target cancer mutation information]: mut start: 98279021: mut end: 98279021: mut class: Silent: mut type: SNP: ref seq: G: mut seq: T: mut aa: p.R28R: mutation info source: CCLE: ref target(-10 +10): TAAAAACCCCGCGCGCTGGG (SEQ ID NO: 2635): mut target(-10 +10): TAAAAACCCCTGCGCGCTGGG (SEQ ID NO: 2636):
[Model Cell line information]: cell: NCIH2126: cancer type: LUNG: PAM dist: 8: indel length: 0: CRISPR gRNA ID: GF-CCELg9-732: [crRNA sequence]: crRNA sequence: CCTCCGGCGGCCCAGCGCGCAGG (SEQ ID NO: 2643):
SpgRNA: attctaatacgactcactataggCCTCCGGCGGCCCAGCGCGCgttttagagctagaaatagcaagttaaaataaggctagtccgtt atcaacttgaaaaagtggcaccgagtcggtgc (SEQ ID NO: 2644): [Target gene information]: Gene ID: 5727: Symbol: PTCH1: Ensembl Transcript ID: EN5T00000375274.2: GRCh: 37: Chr: 9: [Target cancer mutation information]: mut start: 98279021: mut end: 98279021: mut class: Silent: mut type: SNP: ref seq: G: mut seq: T: mut aa: p.R28R: mutation info source: CCLE: ref target(-10 +10): TAAAAACCCCGGCGCGCTGGG (SEQ ID NO: 2635): mut target(-10 +10): TAAAAACCCCTGCGCGCTGGG (SEQ ID NO: 2636):
[Model Cell line information]: cell: NCIH2126: cancer type: LUNG: PAM dist: 0: indel length: 0: CRISPR gRNA ID: GF-CCELg9-733: [crRNA sequence]: crRNA sequence: CTCCGGCGGCCCAGCGCGCAGGG (SEQ ID NO: 2645):
SpgRNA: attctaatacgactcactataggCTCCGGCGGCCCAGCGCGCAgttttagagctagaaatagcaagttaaaataaggctagtccgtt atcaacttgaaaaagtggcaccgagtcggtgc (SEQ ID NO: 2646): [Target gene information]: Gene ID: 5727: Symbol: PTCH1: Ensembl Transcript ID: EN5T00000375274.2: GRCh: 37: Chr: 9: [Target cancer mutation information]: mut start: 98279021: mut end: 98279021: mut class: Silent: mut type: SNP: ref seq: G: mut seq: T: mut aa: p.R28R: mutation info source: CCLE: ref target(-10 +10): TAAAAACCCCGGCGCGCTGGG (SEQ ID NO: 2635): mut target(-10 +10): TAAAAACCCCTGCGCGCTGGG (SEQ ID NO: 2636):
[Model Cell line information]: cell: NCIH2126: cancer type: LUNG: PAM dist: 1: indel length: 0: CRISPR gRNA ID: GF-CCELg9-734: [crRNA sequence]: crRNA sequence: TCCGGCGGCCCAGCGCGCAGGGG (SEQ ID NO: 2647):

TABLE 7-continued

Illustrative guide RNA sequences for polypeptides comprising Cas9

SpgRNA: attctaatacgactcactataggTCCGGCGGCCCAGCGCGCAGgttttagagctagaaatagcaagttaaaataaggctagtccgt
tatcaacttgaaaaagtggcaccgagtcggtgc (SEQ ID NO: 2648): [Target gene information]: Gene ID: 5727: Symbol:
PTCH1: Ensembl Transcript ID: ENST00000375274.2: GRCh: 37: Chr: 9: [Target cancer mutation
information]: mut start: 98279021: mut end: 98279021: mut class: Silent: mut type: SNP: ref seq: G: mut
seq: T: mut aa: p.R28R: mutation info source: CCLE: ref target(-10 +10): TAAAAACCCCGGCGCGCTGGG
(SEQ ID NO: 2635): mut target(-10 +10): TAAAAACCCCTGCGCGCTGGG (SEQ ID NO: 2636):
[Model Cell line information]: cell: NCIH2126: cancer type: LUNG: PAM dist: 2: indel length: 0: CRISPR
gRNA ID: GF-CCELg9-735: [crRNA sequence]: crRNA sequence: AAAAAAATGCGGCAAGTTCTTGG
(SEQ ID NO: 2649):
SpgRNA: attctaatacgactcactataggAAAAAAATGCGGCAAGTTCTgttttagagctagaaatagcaagttaaaataaggctagtccgt
tatcaacttgaaaaagtggcaccgagtcggtgc (SEQ ID NO: 2650): [Target gene information]: Gene ID: 5727: Symbol:
PTCH1: Ensembl Transcript ID: ENST00000331920.6: GRCh: 37: Chr: 9: [Target cancer mutation informa-
tion]: mut start: 98268792: mut end: 98268793: mut class: Frame Shift Ins: mut type: INS: ref seq: -:
mut seq: T: mut aa: p.N97fs: mutation info source: CCLE: ref target(-10 +10): ACTTGCCGCA_-
TTTTTTGAAT (SEQ ID NO: 769): mut target(-10 +10): ACTTGCCGCATTTTTTTGAAT (SEQ ID NO:
770): [Model Cell line information]: cell: NCIH460: cancer type: LUNG: PAM dist: 14: indel length: 1:
CRI S PR gRNA ID: GF-CCELg9-736: [crRNA sequence]: crRNA sequence:
ATGCGGCAAGTTCTTGGTTGTGTG (SEQ ID NO: 2651):
SpgRNA: attctaatacgactcactataggATGCGGCAAGTTCTTGGTTGgttttagagctagaaatagcaagttaaaataaggctagtccgtt
atcaacttgaaaaagtggcaccgagtcggtgc (SEQ ID NO: 2652): [Target gene information]: Gene ID: 5727: Symbol:
PTCH1: Ensembl Transcript ID: ENST00000331920.6: GRCh: 37: Chr: 9: [Target cancer mutation informa-
tion]: mut start: 98268792: mut end: 98268793: mut class: Frame Shift Ins: mut type: INS: ref seq: -:
mut seq: T: mut aa: p.N97fs: mutation info source: CCLE: ref target(-10 +10): ACTTGCCGCA_-
TTTTTTGAAT (SEQ ID NO: 769): mut target(-10 +10): ACTTGCCGCATTTTTTTGAAT (SEQ ID NO:
770): [Model Cell line information]: cell: NCIH460: cancer type: LUNG: PAM dist: 20: indel length: 1:
CRI S PR gRNA ID: GF-CCELg9-737: [crRNA sequence]: crRNA sequence:
TTGTTACATTCAAAAAAATGCGG (SEQ ID NO: 2653):
SpgRNA: attctaatacgactcactataggTTGTTACATTCAAAAAAATGgttttagagctagaaatagcaagttaaaataaggctagtccgtt
atcaacttgaaaaagtggcaccgagtcggtgc (SEQ ID NO: 2654): [Target gene information]: Gene ID: 5727: Symbol:
PTCH1: Ensembl Transcript ID: ENST00000331920.6: GRCh: 37: Chr: 9: [Target cancer mutation
information]: mut start: 98268792: mut end: 98268793: mut class: Frame Shift Ins: mut type: INS: ref
 seq: -: mut seq: T: mut aa: p.N97fs: mutation info source: CCLE: ref target(-10 +10): ACTTGCCGCA_-
TTTTTTGAAT (SEQ ID NO: 769): mut target(-10 +10): ACTTGCCGCATTTTTTTGAAT (SEQ ID NO:
770): [Model Cell line information]: cell: NCIH460: cancer type: LUNG: PAM dist: 3: indel length: 1:
CRISPR gRNA ID: GF-CCELg9-738: [crRNA sequence]: crRNA sequence:
AGTAAGAACCAGAGACAAAAAGG (SEQ ID NO: 2655):
SpgRNA: attctaatacgactcactataggAGTAAGAACCAGAGACAAAAgttttagagctagaaatagcaagttaaaataaggctagtccg
ttatcaacttgaaaaagtggcaccgagtcggtgc (SEQ ID NO: 2656): [Target gene information]: Gene ID: 5728:
Symbol: PTEN: Ensembl Transcript ID: ENST00000371953.3: GRCh: 37: Chr: 10: [Target cancer mutation
information]: mut start: 89692993: mut end: 89692993: mut class: Silent: mut type: SNP: ref seq: G: mut
seq: A: mut aa: p.R159R: mutation info source: CCLE: ref target(-10 +10):
GGGAAGTAAGGACCAGAGACA (SEQ ID NO: 773): mut target(-10 +10):
GGGAAGTAAGAACCAGAGACA (SEQ ID NO: 774): [Model Cell line information]: cell: NC1H1563:
cancer type: LUNG: PAM dist: 14: indel length: 0: CRISPR gRNA ID: GF-CCELg9-739: [crRNA sequence]:
crRNA sequence: CACATCAAGATTCAGAGCACTGG (SEQ ID NO: 2657):
SpgRNA: attctaatacgactcactataggCACATCAAGATTCAGAGCACgttttagagctagaaatagcaagttaaaataaggctagtccgtt
atcaacttgaaaaagtggcaccgagtcggtgc (SEQ ID NO: 2658): [Target gene information]: Gene ID: 5781: Symbol:
PTPN11: Ensembl Transcript ID: EN5T00000351677.2: GRCh: 37: Chr: 12: [Target cancer mutation
information]: mut start: 112888157: mut end: 112888157: mut class: Missense Mutation: mut type: SNP: ref
seq: A: mut seq: G: mut aa: p.N585: mutation info source: CCLE: ref target(-10 +10):
AAGATTCAGAACACTGGTGAT (SEQ ID NO: 2659): mut target(-10 +10):
AAGATTCAGAGCACTGGTGAT (SEQ ID NO: 2660): [Model Cell line information]: cell: NCIH661:
cancer type: LUNG: PAM dist: 4: indel length: 0: CRISPR gRNA ID: GF-CCELg9-740: [crRNA sequence]:
crRNA sequence: CAGTGCTCTGAATCTTGATGTGG (SEQ ID NO: 2661):
SpgRNA: attctaatacgactcactataggCAGTGCTCTGAATCTTGATGgttttagagctagaaatagcaagttaaaataaggctagtccgtt
atcaacttgaaaaagtggcaccgagtcggtgc (SEQ ID NO: 2662): [Target gene information]: Gene ID: 5781: Symbol:
PTPN11: Ensembl Transcript ID: EN5T00000351677.2: GRCh: 37: Chr: 12: [Target cancer mutation
information]: mut start: 112888157: mut end: 112888157: mut class: Missense Mutation: mut type: SNP: ref
seq: A: mut seq: G: mut aa: p.N585: mutation info source: CCLE: ref target(-10 +10):
AAGATTCAGAACACTGGTGAT (SEQ ID NO: 2659): mut target(-10 +10):
AAGATTCAGAGCACTGGTGAT (SEQ ID NO: 2660): [Model Cell line information]: cell: NCIH661:
cancer type: LUNG: PAM dist: 15: indel length: 0: CRISPR gRNA ID: GF-CCELg9-741: [crRNA sequence]:
crRNA sequence: AGTGCTCTGAATCTTGATGTGGG (SEQ ID NO: 2663):
SpgRNA: attctaatacgactcactataggAGTGCTCTGAATCTTGATGTgttttagagctagaaatagcaagttaaaataaggctagtccgtt
atcaacttgaaaaagtggcaccgagtcggtgc (SEQ ID NO: 2664): [Target gene information]: Gene ID: 5781: Symbol:
PTPN11: Ensembl Transcript ID: EN5T00000351677.2: GRCh: 37: Chr: 12: [Target cancer mutation
information]: mut start: 112888157: mut end: 112888157: mut class: Missense Mutation: mut type: SNP: ref
seq: A: mut seq: G: mut aa: p.N58S: mutation info source: CCLE: ref target(-10 +10):
AAGATTCAGAACACTGGTGAT (SEQ ID NO: 2659): mut target(-10 +10):
AAGATTCAGAGCACTGGTGAT (SEQ ID NO: 2660): [Model Cell line information]: cell: NCIH661:
cancer type: LUNG: PAM dist: 16: indel length: 0: CRISPR gRNA ID: GF-CCELg9-742: [crRNA sequence]:
crRNA sequence: CGTTGTCATGACAATCACTCAGG (SEQ ID NO: 2665):
SpgRNA: attctaatacgactcactataggCGTTGTCATGACAATCACTCgttttagagctagaaatagcaagttaaaataaggctagtccgtt
atcaacttgaaaaagtggcaccgagtcggtgc (SEQ ID NO: 2666): [Target gene information]: Gene ID: 5781: Symbol:
PTPN11: Ensembl Transcript ID: EN5T00000351677.2: GRCh: 37: Chr: 12: [Target cancer mutation
information]: mut start: 112915778: mut end: 112915778: mut class: Nonsense Mutation: mut type: SNP: ref TABLE 7-continued Illustrative guide RNA sequences for polypeptides comprising Cas9 seq: C: mut seq: T: mut aa: p.R351*: mutation info source: CCLE: ref target(-10 +10):
AGAAAACTCCCGAGTGATTGT (SEQ ID NO: 783): mut target(-10 +10):
AGAAAACTCCTGAGTGATTGT (SEQ ID NO: 784): [Model Cell line information]: cell: NCIH1573:
cancer type: LUNG: PAM dist: 0: indel length: 0: CRISPR gRNA ID: GF-CCELg9-743: [crRNA sequence]:
crRNA sequence: CAATCACTCAGGAGTTTTCTTGG (SEQ ID NO: 2667):
SpgRNA: attctaatacgactcactataggCAATCACTCAGGAGTTTTCTGttttagagctagaaatagcaagttaaaataaggctagtccgtt
atcaacttgaaaaagtggcaccgagtcggtgc (SEQ ID NO: 2668): [Target gene information]: Gene ID: 5781: Symbol:
PTPN11: Ensembl Transcript ID: EN5T00000351677.2: GRCh: 37: Chr: 12: [Target cancer mutation
information]: mut start: 112915778: mut end: 112915778: mut class: Nonsense Mutation: mut type: SNP: ref
seq: C: mut seq: T: mut aa: p.R351*: mutation info source: CCLE: ref target(-10 +10):
AGAAAACTCCCGAGTGATTGT (SEQ ID NO: 783): mut target(-10 +10):
AGAAAACTCCTGAGTGATTGT (SEQ ID NO: 784): [Model Cell line information]: cell: NCIH1573:
cancer type: LUNG: PAM dist: 11: indel length: 0: CRISPR gRNA ID: GF-CCELg9-744: [crRNA sequence]:
crRNA sequence: ACAGGAGTTCCTGGAGGTTTAGG (SEQ ID NO: 2669):
SpgRNA: attctaatacgactcactataggACAGGAGTTCCTGGAGGTTTGttttagagctagaaatagcaagttaaaataaggctagtccgtt
atcaacttgaaaaagtggcaccgagtcggtgc (SEQ ID NO: 2670): [Target gene information]: Gene ID: 5789: Symbol:
PTPRD: Ensembl Transcript ID: ENST00000381196.4: GRCh: 37: Chr: 9: [Target cancer mutation
informa-
tion]: mut start: 8518422: mut end: 8518422: mut class: Silent: mut type: SNP: ref seq: G: mut seq:
A: mut aa: p.P323P: mutation info source: CCLE: ref target(-10 +10): CTGGAGGTTTGGGTAAGGCTT
(SEQ ID NO: 787): mut target(-10 +10): CTGGAGGTTTAGGTAAGGCTT (SEQ ID NO: 788): [Model
Cell line information]: cell: NCIH460: cancer type: LUNG: PAM dist: 0: indel length: 0: CRISPR gRNA ID:
GF-CCELg9-745: [crRNA sequence]: crRNA sequence: AGTTCCTGGAGGTTTAGGTAAGG (SEQ ID
NO: 2671):
SpgRNA: attctaatacgactcactataggAGTTCCTGGAGGTTTAGGTAGttttagagctagaaatagcaagttaaaataaggctagtccgtt
atcaacttgaaaaagtggcaccgagtcggtgc (SEQ ID NO: 2672): [Target gene information]: Gene ID: 5789: Symbol:
PTPRD: Ensembl Transcript ID: ENST00000381196.4: GRCh: 37: Chr: 9: [Target cancer mutation
informa-
tion]: mut start: 8518422: mut end: 8518422: mut class: Silent: mut type: SNP: ref seq: G: mut seq:
A: mut aa: p.P323P: mutation info source: CCLE: ref target(-10 +10): CTGGAGGTTTGGGTAAGGCTT
(SEQ ID NO: 787): mut target(-10 +10): CTGGAGGTTTAGGTAAGGCTT (SEQ ID NO: 788): [Model
Cell line information]: cell: NCIH460: cancer type: LUNG: PAM dist: 5: indel length: 0: CRISPR gRNA ID:
GF-CCELg9-746: [crRNA sequence]: crRNA sequence: CTGGAGGTTTAGGTAAGGCTTGG (SEQ ID
NO: 2673):
SpgRNA: attctaatacgactcactataggCTGGAGGTTTAGGTAAGGCTgttttagagctagaaatagcaagttaaaataaggctagtccgtt
atcaacttgaaaaagtggcaccgagtcggtgc (SEQ ID NO: 2674): [Target gene information]: Gene ID: 5789: Symbol:
PTPRD: Ensembl Transcript ID: ENST00000381196.4: GRCh: 37: Chr: 9: [Target cancer mutation
informa-
tion]: mut start: 8518422: mut end: 8518422: mut class: Silent: mut type: SNP: ref seq: G: mut seq:
A: mut aa: p.P323P: mutation info source: CCLE: ref target(-10 +10): CTGGAGGTTTGGGTAAGGCTT
(SEQ ID NO: 787): mut target(-10 +10): CTGGAGGTTTAGGTAAGGCTT (SEQ ID NO: 788): [Model
Cell line information]: cell: NCIH460: cancer type: LUNG: PAM dist: 10: indel length: 0: CRISPR gRNA
ID: GF-CCELg9-747: [crRNA sequence]: crRNA sequence: AGGTTTAGGTAAGGCTTGGATGG (SEQ ID
NO: 2675):
SpgRNA: attctaatacgactcactataggAGGTTTAGGTAAGGCTTGGAg agagctagaaatagcaagttaaaataaggctagtccgtt
atcaacttgaaaaagtggcaccgagtcggtgc (SEQ ID NO: 2676): [Target gene information]: Gene ID: 5789: Symbol:
PTPRD: Ensembl Transcript ID: ENST00000381196.4: GRCh: 37: Chr: 9: [Target cancer mutation
informa-
tion]: mut start: 8518422: mut end: 8518422: mut class: Silent: mut type: SNP: ref seq: G: mut seq:
A: mut aa: p.P323P: mutation info source: CCLE: ref target(-10 +10): CTGGAGGTTTGGGTAAGGCTT
(SEQ ID NO: 787): mut target(-10 +10): CTGGAGGTTTAGGTAAGGCTT (SEQ ID NO: 788): [Model
Cell line information]: cell: NCIH460: cancer type: LUNG: PAM dist: 14: indel length: 0: CRISPR gRNA
ID: GF-CCELg9-748: [crRNA sequence]: crRNA sequence: GGTTTAGGTAAGGCTTGGATGGG (SEQ ID
NO: 2677):
SpgRNA: attctaatacgactcactataggGGTTTAGGTAAGGCTTGGATgttttagagctagaaatagcaagttaaaataaggctagtccgtt
atcaacttgaaaaagtggcaccgagtcggtgc (SEQ ID NO: 2678): [Target gene information]: Gene ID: 5789: Symbol:
PTPRD: Ensembl Transcript ID: ENST00000381196.4: GRCh: 37: Chr: 9: [Target cancer mutation
informa-
tion]: mut start: 8518422: mut end: 8518422: mut class: Silent: mut type: SNP: ref seq: G: mut seq:
A: mut aa: p.P323P: mutation info source: CCLE: ref target(-10 +10): CTGGAGGTTTGGGTAAGGCTT
(SEQ ID NO: 787): mut target(-10 +10): CTGGAGGTTTAGGTAAGGCTT (SEQ ID NO: 788): [Model
Cell line information]: cell: NCIH460: cancer type: LUNG: PAM dist: 15: indel length: 0: CRISPR gRNA
ID: GF-CCELg9-749: [crRNA sequence]: crRNA sequence: GTTTAGGTAAGGCTTGGATGGGG (SEQ ID
NO: 2679):
SpgRNA: attctaatacgactcactataggGTTTAGGTAAGGCTTGGATGgttttagagctagaaatagcaagttaaaataaggctagtccgtt
atcaacttgaaaaagtggcaccgagtcggtgc (SEQ ID NO: 2680): [Target gene information]: Gene ID: 5789: Symbol:
PTPRD: Ensembl Transcript ID: ENST00000381196.4: GRCh: 37: Chr: 9: [Target cancer mutation
informa-
tion]: mut start: 8518422: mut end: 8518422: mut class: Silent: mut type: SNP: ref seq: G: mut seq:
A: mut aa: p.P323P: mutation info source: CCLE: ref target(-10 +10): CTGGAGGTTTGGGTAAGGCTT
(SEQ ID NO: 787): mut target(-10 +10): CTGGAGGTTTAGGTAAGGCTT (SEQ ID NO: 788): [Model
Cell line information]: cell: NCIH460: cancer type: LUNG: PAM dist: 16: indel length: 0: CRISPR gRNA
ID: GF-CCELg9-750: [crRNA sequence]: crRNA sequence: TTTAGGTAAGGCTTGGATGGGGG (SEQ ID
NO: 2681):
SpgRNA: attctaatacgactcactataggTTTAGGTAAGGCTTGGATGGgttttagagctagaaatagcaagttaaaataaggctagtccgtt
atcaacttgaaaaagtggcaccgagtcggtgc (SEQ ID NO: 2682): [Target gene information]: Gene ID: 5789: Symbol:
PTPRD: Ensembl Transcript ID: ENST00000381196.4: GRCh: 37: Chr: 9: [Target cancer mutation
informa-
tion]: mut start: 8518422: mut end: 8518422: mut class: Silent: mut type: SNP: ref seq: G: mut seq:

TABLE 7-continued

Illustrative guide RNA sequences for polypeptides comprising Cas9

A: mut aa: p.P323P: mutation info source: CCLE: ref target(-10 +10): CTGGAGGTTTGGGTAAGGCTT
(SEQ ID NO: 787): mut target(-10 +10): CTGGAGGTTTAGGTAAGGCTT (SEQ ID NO: 788): [Model
Cell line information]: cell: NCIH460: cancer type: LUNG: PAM dist: 17: indel length: 0: CRISPR gRNA
ID: GF-CCELg9-751: [crRNA sequence]: crRNA sequence: CAAGCCTTACCTAAACCTCCAGG (SEQ ID
NO: 2683):
SpgRNA: attctaatacgactcactataggCAAGCCTTACCTAAACCTCCg agagctagaaatagcaagttaaaataaggctagtccgtt
atcaacttgaaaaagtggcaccgagtcggtgc (SEQ ID NO: 2684): [Target gene information]: Gene ID: 5789: Symbol:
PTPRD: Ensembl Transcript ID: ENST00000381196.4: GRCh: 37: Chr: 9: [Target cancer mutation
informa-
tion]: mut start: 8518422: mut end: 8518422: mut class: Silent: mut type: SNP: ref seq: G: mut seq:
A: mut aa: p.P323P: mutation info source: CCLE: ref target(-10 +10): CTGGAGGTTTGGGTAAGGCTT
(SEQ ID NO: 787): mut target(-10 +10): CTGGAGGTTTAGGTAAGGCTT (SEQ ID NO: 788): [Model
Cell line information]: cell: NCIH460: cancer type: LUNG: PAM dist: 9: indel length: 0: CRISPR gRNA ID:
GF-CCELg9-752: [crRNA sequence]: crRNA sequence: TTACATGAATGCCAACTACGTGG (SEQ ID
NO: 2685):
SpgRNA: attctaatacgactcactataggTTACATGAATGCCAACTACGgttttagagctagaaatagcaagttaaaataaggctagtccgtt
atcaacttgaaaaagtggcaccgagtcggtgc (SEQ ID NO: 2686): [Target gene information]: Gene ID: 5802: Symbol:
PTPRS: Ensembl Transcript ID: EN5T00000587303.1: GRCh: 37: Chr: 19: [Target cancer mutation
information]: mut start: 5214725: mut end: 5214725: mut class: Missense Mutation: mut type: SNP: ref seq:
G: mut seq: C: mut aa: p.I1447M: mutation info source: CCLE: ref target(-10 +10):
AGTTGGCATTGATGTAATCAC (SEQ ID NO: 2687): mut target(-10 +10):
AGTTGGCATTCATGTAATCAC (SEQ ID NO: 2688): [Model Cell line information]: cell: NCIH1563:
cancer type: LUNG: PAM dist: 14: indel length: 0: CRISPR gRNA ID: GF-CCELg9-753: [crRNA sequence]:
crRNA sequence: ATGAATGCCAACTACGTGGACGG (SEQ ID NO: 2689):
SpgRNA: attctaatacgactcactataggATGAATGCCAACTACGTGGAgttttagagctagaaatagcaagttaaaataaggctagtccgtt
atcaacttgaaaaagtggcaccgagtcggtgc (SEQ ID NO: 2690): [Target gene information]: Gene ID: 5802: Symbol:
PTPRS: Ensembl Transcript ID: EN5T00000587303.1: GRCh: 37: Chr: 19: [Target cancer mutation
information]: mut start: 5214725: mut end: 5214725: mut class: Missense Mutation: mut type: SNP: ref seq:
G: mut seq: C: mut aa: p.I1447M: mutation info source: CCLE: ref target(-10 +10):
AGTTGGCATTGATGTAATCAC (SEQ ID NO: 2687): mut target(-10 +10):
AGTTGGCATTCATGTAATCAC (SEQ ID NO: 2688): [Model Cell line information]: cell: NCIH1563:
cancer type: LUNG: PAM dist: 18: indel length: 0: CRISPR gRNA ID: GF-CCELg9-754: [crRNA sequence]:
crRNA sequence: CGTCTCACACACACTGCAGATGG (SEQ ID NO: 2691):
SpgRNA: attctaatacgactcactataggCGTCTCACACACACTGCAGAgttttagagctagaaatagcaagttaaaataaggctagtccgtt
atcaacttgaaaaagtggcaccgagtcggtgc (SEQ ID NO: 2692): [Target gene information]: Gene ID: 11122:
Symbol: PTPRT: Ensembl Transcript ID: EN5T00000373187.1: GRCh: 37: Chr: 20: [Target cancer mutation
information]: mut start: 40710604: mut end: 40710604: mut class: Missense Mutation: mut type: SNP: ref
seq: A: mut seq: G: mut aa: p.M1397T: mutation info source: CCLE: ref target(-10 +10):
CTGCTGGATCATCTCACACAC (SEQ ID NO: 793): mut target(-10 +10):
CTGCTGGATCGTCTCACACAC (SEQ ID NO: 794): [Model Cell line information]: cell: NCIH1563:
cancer type: LUNG: PAM dist: 19: indel length: 0: CRISPR gRNA ID: GF-CCELg9-755: [crRNA sequence]:
crRNA sequence: CACGGGGTGTCACAATGTTTAGG (SEQ ID NO: 2693):
SpgRNA: attctaatacgactcactataggCACGGGGTGTCACAATGTTTgttttagagctagaaatagcaagttaaaataaggctagtccgtt
atcaacttgaaaaagtggcaccgagtcggtgc (SEQ ID NO: 2694): [Target gene information]: Gene ID: 11122:
Symbol: PTPRT: Ensembl Transcript ID: EN5T00000373187.1: GRCh: 37: Chr: 20: [Target cancer mutation
information]: mut start: 40730932: mut end: 40730932: mut class: Silent: mut type: SNP: ref seq: G: mut
seq: T: mut aa: p.L1182L: mutation info source: CCLE: ref target(-10 +10):
TCACAATGTTGAGGGTCTGTG (SEQ ID NO: 799): mut target(-10 +10):
TCACAATGTTTAGGGTCTGTG (SEQ ID NO: 800): [Model Cell line information]: cell: NCIH1573:
cancer type: LUNG: PAM dist: 1: indel length: 0: CRISPR gRNA ID: GF-CCELg9-756: [crRNA sequence]:
crRNA sequence: TTAGGGTCTGTGGGGCACAAAGG (SEQ ID NO: 2695):
SpgRNA: attctaatacgactcactataggTTAGGGTCTGTGGGGCACAAAGgttttagagctagaaatagcaagttaaaataaggctagtccgtt
atcaacttgaaaaagtggcaccgagtcggtgc (SEQ ID NO: 2696): [Target gene information]: Gene ID: 11122:
Symbol: PTPRT: Ensembl Transcript ID: EN5T00000373187.1: GRCh: 37: Chr: 20: [Target cancer mutation
information]: mut start: 40730932: mut end: 40730932: mut class: Silent: mut type: SNP: ref seq: G: mut
seq: T: mut aa: p.L1182L: mutation info source: CCLE: ref target(-10 +10):
TCACAATGTTGAGGGTCTGTG (SEQ ID NO: 799): mut target(-10 +10):
TCACAATGTTTAGGGTCTGTG (SEQ ID NO: 800): [Model Cell line information]: cell: NCIH1573:
cancer type: LUNG: PAM dist: 19: indel length: 0: CRISPR gRNA ID: GF-CCELg9-757: [crRNA sequence]:
crRNA sequence: GTCACAATGTTTAGGGTCTGTGG (SEQ ID NO: 2697):
SpgRNA: attctaatacgactcactataggGTCACAATGTTTAGGGTCTGg ttttagagctagaaatagcaagttaaaataaggctagtccgtt
atcaacttgaaaaagtggcaccgagtcggtgc (SEQ ID NO: 2698): [Target gene information]: Gene ID: 11122:
Symbol: PTPRT: Ensembl Transcript ID: EN5T00000373187.1: GRCh: 37: Chr: 20: [Target cancer mutation
information]: mut start: 40730932: mut end: 40730932: mut class: Silent: mut type: SNP: ref seq: G: mut
seq: T: mut aa: p.L1182L: mutation info source: CCLE: ref target(-10 +10):
TCACAATGTTGAGGGTCTGTG (SEQ ID NO: 799): mut target(-10 +10):
TCACAATGTTTAGGGTCTGTG (SEQ ID NO: 800): [Model Cell line information]: cell: NCIH1573:
cancer type: LUNG: PAM dist: 9: indel length: 0: CRISPR gRNA ID: GF-CCELg9-758: [crRNA sequence]:
crRNA sequence: ACGGGGTGTCACAATGTTTAGG (SEQ ID NO: 2699):
SpgRNA: attctaatacgactcactataggACGGGGTGTCACAATGTTTAgttttagagctagaaatagcaagttaaaataaggctagtccgtt
atcaacttgaaaaagtggcaccgagtcggtgc (SEQ ID NO: 2700): [Target gene information]: Gene ID: 11122:
Symbol: PTPRT: Ensembl Transcript ID: EN5T00000373187.1: GRCh: 37: Chr: 20: [Target cancer mutation
information]: mut start: 40730932: mut end: 40730932: mut class: Silent: mut type: SNP: ref seq: G: mut
seq: T: mut aa: p.L1182L: mutation info source: CCLE: ref target(-10 +10):
TCACAATGTTGAGGGTCTGTG (SEQ ID NO: 799): mut target(-10 +10):
TCACAATGTTTAGGGTCTGTG (SEQ ID NO: 800): [Model Cell line information]: cell: NCIH1573:
cancer type: LUNG: PAM dist: 2: indel length: 0: CRISPR gRNA ID: GF-CCELg9-759: [crRNA sequence]:
crRNA sequence: TCACAATGTTTAGGGTCTGTGGG (SEQ ID NO: 2701):

TABLE 7-continued

Illustrative guide RNA sequences for polypeptides comprising Cas9

SpgRNA: attctaatacgactcactataggTCACAATGTTTAGGGTCTGTgttttagagctagaaatagcaagttaaaataaggctagtccgtt
atcaacttgaaaaagtggcaccgagtcggtgc (SEQ ID NO: 2702): [Target gene information]: Gene ID: 11122:
Symbol: PTPRT: Ensembl Transcript ID: EN5T00000373187.1: GRCh: 37: Chr: 20: [Target cancer mutation
information]: mut start: 40730932: mut end: 40730932: mut class: Silent: mut type: SNP: ref seq: G: mut
seq: T: mut aa: p.L1182L: mutation info source: CCLE: ref target(-10 +10):
TCACAATGTTGAGGGTCTGTG (SEQ ID NO: 799): mut target(-10 +10):
TCACAATGTTTAGGGTCTGTG (SEQ ID NO: 800): [Model Cell line information]: cell: NCIH1573:
cancer type: LUNG: PAM dist: 10: indel length: 0: CRISPR gRNA ID: GF-CCELg9-760: [crRNA sequence]:
crRNA sequence: CACAATGTTTAGGGTCTGTGGGG (SEQ ID NO: 2703):
SpgRNA: attctaatacgactcactataggCACAATGTTTAGGGTCTGTGgttttagagctagaaatagcaagttaaaataaggctagtccgtt
atcaacttgaaaaagtggcaccgagtcggtgc (SEQ ID NO: 2704): [Target gene information]: Gene ID: 11122:
Symbol: PTPRT: Ensembl Transcript ID: ENST00000373187.1: GRCh: 37: Chr: 20: [Target cancer mutation
information]: mut start: 40730932: mut end: 40730932: mut class: Silent: mut type: SNP: ref seq: G: mut
seq: T: mut aa: p.L1182L: mutation info source: CCLE: ref target(-10 +10):
TCACAATGTTGAGGGTCTGTG (SEQ ID NO: 799): mut target(-10 +10):
TCACAATGTTTAGGGTCTGTG (SEQ ID NO: 800): [Model Cell line information]: cell: NCIH1573:
cancer type: LUNG: PAM dist: 11: indel length: 0: CRISPR gRNA ID: GF-CCELg9-761: [crRNA sequence]:
crRNA sequence: ACAAAGTCATGAAATTCTTCAGG (SEQ ID NO: 2705):
SpgRNA: attctaatacgactcactataggACAAAGTCATGAAATTCTTCAGGgttttagagctagaaatagcaagttaaaataaggctagtccgtt
atcaacttgaaaaagtggcaccgagtcggtgc (SEQ ID NO: 2706): [Target gene information]: Gene ID: 5885: Symbol:
RAD21: Ensembl Transcript ID: EN5T00000297338.2: GRCh: 37: Chr: 8: [Target cancer mutation
information]: mut start: 117874101: mut end: 117874101: mut class: Missense Mutation: mut type: SNP: ref
seq: T: mut seq: A: mut aa: p.D118V: mutation info source: CCLE: ref target(-10 +10):
CAGTGGCTGATCAAAGTCATG (SEQ ID NO: 805): mut target(-10 +10):
CAGTGGCTGAACAAAGTCATG (SEQ ID NO: 806): [Model Cell line information]: cell: NCIH460:
cancer type: LUNG: PAM dist: 20: indel length: 0: CRISPR gRNA ID: GF-CCELg9-762: [crRNA sequence]:
crRNA sequence: GTGACTGGTCTCAGTTATCGAGG (SEQ ID NO: 2707):
SpgRNA: attctaatacgactcactataggGTGACTGGTCTCAGTTATCGgttttagagctagaaatagcaagttaaaataaggctagtccgtt
atcaacttgaaaaagtggcaccgagtcggtgc (SEQ ID NO: 2708): [Target gene information]: Gene ID: 5890: Symbol:
RAD51B: Ensembl Transcript ID: ENST00000487270.1: GRCh: 37: Chr: 14: [Target cancer mutation
information]: mut start: 68292228: mut end: 68292228: mut class: Silent: mut type: SNP: ref seq: G: mut
seq: C: mut aa: p.L44L: mutation info source: CCLE: ref target(-10 +10): TGACTGGTCTGAGTTATCGAG
(SEQ ID NO: 2709): mut target(-10 +10): TGACTGGTCTCAGTTATCGAG (SEQ ID NO: 2710): [Model
Cell line information]: cell: NCIH1563: cancer type: LUNG: PAM dist: 9: indel length: 0: CRISPR gRNA
ID: GF-CCELg9-763: [crRNA sequence]: crRNA sequence: CAGATCCGGCCACCCCCTAATGG (SEQ ID
NO: 2711):
SpgRNA: attctaatacgactcactataggCAGATCCGGCCACCCCCTAAgttttagagctagaaatagcaagttaaaataaggctagtccgtt
atcaacttgaaaaagtggcaccgagtcggtgc (SEQ ID NO: 2712): [Target gene information]: Gene ID: 8438: Symbol:
RAD54L: Ensembl Transcript ID: ENST00000371975.4: GRCh: 37: Chr: 1: [Target cancer mutation
information]: mut start: 46743793: mut end: 46743793: mut class: Missense Mutation: mut type: SNP: ref
seq: G: mut seq: A: mut aa: p.D695N: mutation info source: CCLE: ref target(-10 +10):
GCCACCCCCTGATGGTTCTGA (SEQ ID NO: 2713): mut target(-10 +10):
GCCACCCCCTAATGGTTCTGA (SEQ ID NO: 2714): [Model Cell line information]: cell: NCIH1563:
cancer type: LUNG: PAM dist: 2: indel length: 0: CRISPR gRNA ID: GF-CCELg9-764: [crRNA sequence]:
crRNA sequence: GAAGTGCAGTCAGAACCATTAGG (SEQ ID NO: 2715):
SpgRNA: attctaatacgactcactataggGAAGTGCAGTCAGAACCATTgttttagagctagaaatagcaagttaaaataaggctagtccgtt
atcaacttgaaaaagtggcaccgagtcggtgc (SEQ ID NO: 2716): [Target gene information]: Gene ID: 8438: Symbol:
RAD54L: Ensembl Transcript ID: ENST00000371975.4: GRCh: 37: Chr: 1: [Target cancer mutation
information]: mut start: 46743793: mut end: 46743793: mut class: Missense Mutation: mut type: SNP: ref
seq: G: mut seq: A: mut aa: p.D695N: mutation info source: CCLE: ref target(-10 +10):
GCCACCCCCTGATGGTTCTGA (SEQ ID NO: 2713): mut target(-10 +10):
GCCACCCCCTAATGGTTCTGA (SEQ ID NO: 2714): [Model Cell line information]: cell: NCIH1563:
cancer type: LUNG: PAM dist: 1: indel length: 0: CRISPR gRNA ID: GF-CCELg9-765: [crRNA sequence]:
crRNA sequence: CAGTCAGAACCATTAGGGGGTGG (SEQ ID NO: 2717):
SpgRNA: attctaatacgactcactataggCAGTCAGAACCATTAGGGGGgttttagagctagaaatagcaagttaaaataaggctagtccgt
tatcaacttgaaaaagtggcaccgagtcggtgc (SEQ ID NO: 2718): [Target gene information]: Gene ID: 8438: Symbol:
RAD54L: Ensembl Transcript ID: ENST00000371975.4: GRCh: 37: Chr: 1: [Target cancer mutation
information]: mut start: 46743793: mut end: 46743793: mut class: Missense Mutation: mut type: SNP: ref
seq: G: mut seq: A: mut aa: p.D695N: mutation info source: CCLE: ref target(-10 +10):
GCCACCCCCTGATGGTTCTGA (SEQ ID NO: 2713): mut target(-10 +10):
GCCACCCCCTAATGGTTCTGA (SEQ ID NO: 2714): [Model Cell line information]: cell: NCIH1563:
cancer type: LUNG: PAM dist: 7: indel length: 0: CRISPR gRNA ID: GF-CCELg9-766: [crRNA sequence]:
crRNA sequence: CAGAACCATTAGGGGTGGCCGG (SEQ ID NO: 2719):
SpgRNA: attctaatacgactcactataggCAGAACCATTAGGGGTGGCgttttagagctagaaatagcaagttaaaataaggctagtccgt
tatcaacttgaaaaagtggcaccgagtcggtgc (SEQ ID NO: 2720): [Target gene information]: Gene ID: 8438: Symbol:
RAD54L: Ensembl Transcript ID: ENST00000371975.4: GRCh: 37: Chr: 1: [Target cancer mutation
information]: mut start: 46743793: mut end: 46743793: mut class: Missense Mutation: mut type: SNP: ref
seq: G: mut seq: A: mut aa: p.D695N: mutation info source: CCLE: ref target(-10 +10):
GCCACCCCCTGATGGTTCTGA (SEQ ID NO: 2713): mut target(-10 +10):
GCCACCCCCTAATGGTTCTGA (SEQ ID NO: 2714): [Model Cell line information]: cell: NCIH1563:
cancer type: LUNG: PAM dist: 11: indel length: 0: CRISPR gRNA ID: GF-CCELg9-767: [crRNA sequence]:
crRNA sequence: TAGGGGTGGCCGGATCTGACGG (SEQ ID NO: 2721):
SpgRNA: attctaatacgactcactataggCAGTCAGAACCATTAGGGGgttttagagctagaaatagcaagttaaaataaggctagtccgt
tatcaacttgaaaaagtggcaccgagtcggtgc (SEQ ID NO: 2722): [Target gene information]: Gene ID: 8438: Symbol:
RAD54L: Ensembl Transcript ID: ENST00000371975.4: GRCh: 37: Chr: 1: [Target cancer mutation
information]: mut start: 46743793: mut end: 46743793: mut class: Missense Mutation: mut type: SNP: ref
seq: G: mut seq: A: mut aa: p.D695N: mutation info source: CCLE: ref target(-10 +10):
GCCACCCCCTGATGGTTCTGA (SEQ ID NO: 2713): mut target(-10 +10):

TABLE 7-continued

Illustrative guide RNA sequences for polypeptides comprising Cas9

GCCACCCCTAATGGTTCTGA (SEQ ID NO: 2714): [Model Cell line information]: cell: NCIH1563: cancer type: LUNG: PAM dist: 20: indel length: 0: CRISPR gRNA ID: GF-CCELg9-768: [crRNA sequence]: crRNA sequence: AAGTGCAGTCAGAACCATTAGGG (SEQ ID NO: 2723):
SpgRNA: attctaatacgactcactataggAAGTGCAGTCAGAACCATTAgttttagagctagaaatagcaagttaaaataaggctagtccgtt atcaacttgaaaaagtggcaccgagtcggtgc (SEQ ID NO: 2724): [Target gene information]: Gene ID: 8438: Symbol: RAD54L: Ensembl Transcript ID: ENST00000371975.4: GRCh: 37: Chr: 1: [Target cancer mutation information]: mut start: 46743793: mut end: 46743793: mut class: Missense Mutation: mut type: SNP: ref seq: G: mut seq: A: mut aa: p.D695N: mutation info source: CCLE: ref target(-10 +10):
GCCACCCCTGATGGTTCTGA (SEQ ID NO: 2713): mut target(-10 +10):
GCCACCCCTAATGGTTCTGA (SEQ ID NO: 2714): [Model Cell line information]: cell: NCIH1563:
cancer type: LUNG: PAM dist: 2: indel length: 0: CRISPR gRNA ID: GF-CCELg9-769: [crRNA sequence]:
crRNA sequence: AGTGCAGTCAGAACCATTAGGGG (SEQ ID NO: 2725):
SpgRNA: attctaatacgactcactataggAGTGCAGTCAGAACCATTAGGgttttagagctagaaatagcaagttaaaataaggctagtccgtt atcaacttgaaaaagtggcaccgagtcggtgc (SEQ ID NO: 2726): [Target gene information]: Gene ID: 8438: Symbol: RAD54L: Ensembl Transcript ID: ENST00000371975.4: GRCh: 37: Chr: 1: [Target cancer mutation information]: mut start: 46743793: mut end: 46743793: mut class: Missense Mutation: mut type: SNP: ref seq: G: mut seq: A: mut aa: p.D695N: mutation info source: CCLE: ref target(-10 +10):
GCCACCCCTGATGGTTCTGA (SEQ ID NO: 2713): mut target(-10 +10):
GCCACCCCTAATGGTTCTGA (SEQ ID NO: 2714): [Model Cell line information]: cell: NCIH1563:
cancer type: LUNG: PAM dist: 3: indel length: 0: CRISPR gRNA ID: GF-CCELg9-770: [crRNA sequence]:
crRNA sequence: GTGCAGTCAGAACCATTAGGGGG (SEQ ID NO: 2727):
SpgRNA: attctaatacgactcactataggGTGCAGTCAGAACCATTAGGgttttagagctagaaatagcaagttaaaataaggctagtccgtt atcaacttgaaaaagtggcaccgagtcggtgc (SEQ ID NO: 2728): [Target gene information]: Gene ID: 8438: Symbol: RAD54L: Ensembl Transcript ID: ENST00000371975.4: GRCh: 37: Chr: 1: [Target cancer mutation information]: mut start: 46743793: mut end: 46743793: mut class: Missense Mutation: mut type: SNP: ref seq: G: mut seq: A: mut aa: p.D695N: mutation info source: CCLE: ref target(-10 +10):
GCCACCCCTGATGGTTCTGA (SEQ ID NO: 2713): mut target(-10 +10):
GCCACCCCTAATGGTTCTGA (SFT) TT) NO77141 flUnclel Cell line infrwmatinnl eel]
cancer type: LUNG: PAM dist: 4: indel length: 0: CRISPR gRNA ID: GF-CCELg9-771: [crRNA sequence]:
crRNA sequence: TGATCTGGTCGGTGATGGTGAGG (SEQ ID NO: 2729):
SpgRNA: attctaatacgactcactataggTGATCTGGTCGGTGATGGTGgttttagagctagaaatagcaagttaaaataaggctagtccgtt atcaacttgaaaaagtggcaccgagtcggtgc (SEQ ID NO: 273 0): [Target gene information]: Gene ID: 5914: Symbol: RARA: Ensembl Transcript ID: EN5T00000254066.5: GRCh: 37: Chr: 17: [Target cancer mutation information]: mut start: 38508715: mut end: 38508715: mut class: Missense Mutation: mut type: SNP: ref seq: G: mut seq: A: mut aa: p.A255T: mutation info source: CCLE: ref target(-10 +10):
CCTCACCATCGCCGACCAGAT (SEQ ID NO: 2731): mut target(-10 +10):
CCTCACCATCACCGACCAGAT (SEQ ID NO: 2732): [Model Cell line information]: cell: NCIH2126:
cancer type: LUNG: PAM dist: 8: indel length: 0: CRISPR gRNA ID: GF-CCELg9-772: [crRNA sequence]:
crRNA sequence: GAGGGTGATCTGGTCGGTGATGG (SEQ ID NO: 2733):
SpgRNA: attctaatacgactcactataggGAGGGTGATCTGGTCGGTGATGGgttttagagctagaaatagcaagttaaaataaggctagtccgtt atcaacttgaaaaagtggcaccgagtcggtgc (SEQ ID NO: 273 4): [Target gene information]: Gene ID: 5914: Symbol: RARA: Ensembl Transcript ID: EN5T00000254066.5: GRCh: 37: Chr: 17: [Target cancer mutation information]: mut start: 38508715: mut end: 38508715: mut class: Missense Mutation: mut type: SNP: ref seq: G: mut seq: A: mut aa: p.A255T: mutation info source: CCLE: ref target(-10 +10):
CCTCACCATCGCCGACCAGAT (SEQ ID NO: 2731): mut target(-10 +10):
CCTCACCATCACCGACCAGAT (SEQ ID NO: 2732): [Model Cell line information]: cell: NCIH2126:
cancer type: LUNG: PAM dist: 3: indel length: 0: CRISPR gRNA ID: GF-CCELg9-773: [crRNA sequence]:
crRNA sequence: CTGGTCGGTGATGGTGAGGGTGG (SEQ ID NO: 2735):
SpgRNA: attctaatacgactcactataggCTGGTCGGTGATGGTGAGGGgttttagagctagaaatagcaagttaaaataaggctagtccgtt atcaacttgaaaaagtggcaccgagtcggtgc (SEQ ID NO: 273 6): [Target gene information]: Gene ID: 5914: Symbol: RARA: Ensembl Transcript ID: EN5T00000254066.5: GRCh: 37: Chr: 17: [Target cancer mutation information]: mut start: 38508715: mut end: 38508715: mut class: Missense Mutation: mut type: SNP: ref seq: G: mut seq: A: mut aa: p.A255T: mutation info source: CCLE: ref target(-10 +10):
CCTCACCATCGCCGACCAGAT (SEQ ID NO: 2731): mut target(-10 +10):
CCTCACCATCACCGACCAGAT (SEQ ID NO: 2732): [Model Cell line information]: cell: NCIH2126:
cancer type: LUNG: PAM dist: 12: indel length: 0: CRISPR gRNA ID: GF-CCELg9-774: [crRNA sequence]:
crRNA sequence: GATCTGGTCGGTGATGGTGAGGG (SEQ ID NO: 2737):
SpgRNA: attctaatacgactcactataggGATCTGGTCGGTGATGGTGAgttttagagctagaaatagcaagttaaaataaggctagtccgtt atcaacttgaaaaagtggcaccgagtcggtgc (SEQ ID NO: 273 8): [Target gene information]: Gene ID: 5914: Symbol: RARA: Ensembl Transcript ID: EN5T00000254066.5: GRCh: 37: Chr: 17: [Target cancer mutation information]: mut start: 38508715: mut end: 38508715: mut class: Missense Mutation: mut type: SNP: ref seq: G: mut seq: A: mut aa: p.A255T: mutation info source: CCLE: ref target(-10 +10):
CCTCACCATCGCCGACCAGAT (SEQ ID NO: 2731): mut target(-10 +10):
CCTCACCATCACCGACCAGAT (SEQ ID NO: 2732): [Model Cell line information]: cell: NCIH2126:
cancer type: LUNG: PAM dist: 9: indel length: 0: CRISPR gRNA ID: GF-CCELg9-775: [crRNA sequence]:
crRNA sequence: TCTTCGCGAGTATGGCAGCCAGG (SEQ ID NO: 2739):
SpgRNA: attctaatacgactcactataggTCTTCGCGAGTATGGCAGCCgttttagagctagaaatagcaagttaaaataaggctagtccgtt atcaacttgaaaaagtggcaccgagtcggtgc (SEQ ID NO: 2740): [Target gene information]: Gene ID: 8241: Symbol: RBM10: Ensembl Transcript ID: EN5T00000377604.3: GRCh: 37: Chr: X: [Target cancer mutation information]: mut start: 47028830: mut end: 47028830: mut class: Missense Mutation: mut type: SNP: ref seq: C: mut seq: T: mut aa: p.P45L: mutation info source: CCLE: ref target(-10 +10):
CGTTCATATCCTCGCGAGTAT (SEQ ID NO: 2741): mut target(-10 +10):
CGTTCATATCTTCGCGAGTAT (SEQ ID NO: 2742): [Model Cell line information]: cell: NCIH1437:
cancer type: LUNG: PAM dist: 18: indel length: 0: CRISPR gRNA ID: GF-CCELg9-776: [crRNA sequence]:
crRNA sequence: CGTTCATATCTTCGCGAGTATGG (SEQ ID NO: 2743):
SpgRNA: attctaatacgactcactataggCGTTCATATCTTCGCGAGTAgttttagagctagaaatagcaagttaaaataaggctagtccgtt atcaacttgaaaaagtggcaccgagtcggtgc (SEQ ID NO: 2744): [Target gene information]: Gene ID: 8241: Symbol: RBM10: Ensembl Transcript ID: EN5T00000377604.3: GRCh: 37: Chr: X: [Target cancer mutation TABLE 7-continued Illustrative guide RNA sequences for polypeptides comprising Cas9 information]: mut start: 47028830: mut end: 47028830: mut class: Missense Mutation: mut type: SNP: ref seq: C: mut seq: T: mut aa: p.P45L: mutation info source: CCLE: ref target(-10 +10):
CGTTCATATCCCTCGCGAGTAT (SEQ ID NO: 2741): mut target(-10 +10):
CGTTCATATCTTCGCGAGTAT (SEQ ID NO: 2742): [Model Cell line information]: cell: NCIH1437: cancer type: LUNG: PAM dist: 10: indel length: 0: CRISPR gRNA ID: GF-CCELg9-777: [crRNA sequence]: crRNA sequence: CATACTCGCGAAGATATGAACGG (SEQ ID NO: 2745):
SpgRNA: attctaatacgactcactataggCATACTCGCGAAGATATGAAgttttagagctagaaatagcaagttaaaataaggctagtccgtt atcaacttgaaaaagtggcaccgagtcggtgc (SEQ ID NO: 2746): [Target gene information]: Gene ID: 8241: Symbol: RBM10: Ensembl Transcript ID: EN5T00000377604.3: GRCh: 37: Chr: X: [Target cancer mutation information]: mut start: 47028830: mut end: 47028830: mut class: Missense Mutation: mut type: SNP: ref seq: C: mut seq: T: mut aa: p.P45L: mutation info source: CCLE: ref target(-10 +10):
CGTTCATATCCCTCGCGAGTAT (SEQ ID NO: 2741): mut target(-10 +10):
CGTTCATATCTTCGCGAGTAT (SEQ ID NO: 2742): [Model Cell line information]: cell: NCIH1437: cancer type: LUNG: PAM dist: 9: indel length: 0: CRISPR gRNA ID: GF-CCELg9-778: [crRNA sequence]: crRNA sequence: TGCGCCGTACTTCCTCCTCTTGG (SEQ ID NO: 2747):
SpgRNA: attctaatacgactcactataggTGCGCCGTACTTCCTCCTCTgttttagagctagaaatagcaagttaaaataaggctagtccgtta tcaacttgaaaaagtggcaccgagtcggtgc (SEQ ID NO: 2748): [Target gene information]: Gene ID: 8241: Symbol: RBM10: Ensembl Transcript ID: EN5T00000377604.3: GRCh: 37: Chr: X: [Target cancer mutation information]: mut start: 47045551: mut end: 47045551: mut class: Frame Shift Del: mut type: DEL: ref seq: G: mut seq: -: mut aa: p.G840fs: mutation info source: CCLE: ref target(-10 +10):
GAAGTACGGCGGCATATCCAC (SEQ ID NO: 2749): mut target(-10 +10): GAAGTACGGC-GCATATCCAC (SEQ ID NO: 2750): [Model Cell line information]: cell: NCIH1975: cancer type: LUNG: PAM dist: 18: indel length: 1: CRISPR gRNA ID: GF-CCELg9-779: [crRNA sequence]: crRNA sequence: GCGCCGTACTTCCTCCTCTTGGG (SEQ ID NO: 2751):
SpgRNA: attctaatacgactcactataggGCGCCGTACTTCCTCCTCTTgttttagagctagaaatagcaagttaaaataaggctagtccgtta tcaacttgaaaaagtggcaccgagtcggtgc (SEQ ID NO: 2752): [Target gene information]: Gene ID: 8241: Symbol: RBM10: Ensembl Transcript ID: EN5T00000377604.3: GRCh: 37: Chr: X: [Target cancer mutation information]: mut start: 47045551: mut end: 47045551: mut class: Frame Shift Del: mut type: DEL: ref seq: G: mut seq: -: mut aa: p.G840fs: mutation info source: CCLE: ref target(-10 +10):
GAAGTACGGCGGCATATCCAC (SEQ ID NO: 2749): mut target(-10 +10): GAAGTACGGC-GCATATCCAC (SEQ ID NO: 2750): [Model Cell line information]: cell: NCIH1975: cancer type: LUNG: PAM dist: 19: indel length: 1: CRISPR gRNA ID: GF-CCELg9-780: [crRNA sequence]: crRNA sequence: GGAATTCCCTCGGAAGAGCTTGG (SEQ ID NO: 2753):
SpgRNA: attctaatacgactcactataggGGAATTCCCTCGGAAGAGCTgttttagagctagaaatagcaagttaaaataaggctagtccgtt atcaacttgaaaaagtggcaccgagtcggtgc (SEQ ID NO: 2754): [Target gene information]: Gene ID: 5979: Symbol: RET: Ensembl Transcript ID: EN5T00000355710.3: GRCh: 37: Chr: 10: [Target cancer mutation information]: mut start: 43612063: mut end: 43612063: mut class: Missense Mutation: mut type: SNP: ref seq: A: mut seq: G: mut aa: p.N723S: mutation info source: CCLE: ref target(-10 +10):
CCTCGGAAGAACTTGGTTCTT (SEQ ID NO: 849): mut target(-10 +10):
CCTCGGAAGAGCTTGGTTCTT (SEQ ID NO: 850): [Model Cell line information]: cell: HCC827GR5: cancer type: LUNG: PAM dist: 3: indel length: 0: CRISPR gRNA ID: GF-CCELg9-781: [crRNA sequence]: crRNA sequence: CCTCGGAAGAGCTTGGTTCTTGG (SEQ ID NO: 2755):
SpgRNA: attctaatacgactcactataggCCTCGGAAGAGCTTGGTTCTgttttagagctagaaatagcaagttaaaataaggctagtccgtt atcaacttgaaaaagtggcaccgagtcggtgc (SEQ ID NO: 2756): [Target gene information]: Gene ID: 5979: Symbol: RET: Ensembl Transcript ID: EN5T00000355710.3: GRCh: 37: Chr: 10: [Target cancer mutation information]: mut start: 43612063: mut end: 43612063: mut class: Missense Mutation: mut type: SNP: ref seq: A: mut seq: G: mut aa: p.N723S: mutation info source: CCLE: ref target(-10 +10):
CCTCGGAAGAACTTGGTTCTT (SEQ ID NO: 849): mut target(-10 +10):
CCTCGGAAGAGCTTGGTTCTT (SEQ ID NO: 850): [Model Cell line information]: cell: HCC827GR5: cancer type: LUNG: PAM dist: 10: indel length: 0: CRISPR gRNA ID: GF-CCELg9-782: [crRNA sequence]: crRNA sequence: CCAAGAACCAAGCTCTTCCGAGG (SEQ ID NO: 2757):
SpgRNA: attctaatacgactcactataggCCAAGAACCAAGCTCTTCCGgttttagagctagaaatagcaagttaaaataaggctagtccgtt atcaacttgaaaaagtggcaccgagtcggtgc (SEQ ID NO: 2758): [Target gene information]: Gene ID: 5979: Symbol: RET: Ensembl Transcript ID: EN5T00000355710.3: GRCh: 37: Chr: 10: [Target cancer mutation information]: mut start: 43612063: mut end: 43612063: mut class: Missense Mutation: mut type: SNP: ref seq: A: mut seq: G: mut aa: p.N723S: mutation info source: CCLE: ref target(-10 +10):
CCTCGGAAGAACTTGGTTCTT (SEQ ID NO: 849): mut target(-10 +10):
CCTCGGAAGAGCTTGGTTCTT (SEQ ID NO: 850): [Model Cell line information]: cell: HCC827GR5: cancer type: LUNG: PAM dist: 8: indel length: 0: CRISPR gRNA ID: GF-CCELg9-783: [crRNA sequence]: crRNA sequence: CAAGAACCAAGCTCTTCCGAGGG (SEQ ID NO: 2759):
SpgRNA: attctaatacgactcactataggCAAGAACCAAGCTCTTCCGAgttttagagctagaaatagcaagttaaaataaggctagtccgtt atcaacttgaaaaagtggcaccgagtcggtgc (SEQ ID NO: 2760): [Target gene information]: Gene ID: 5979: Symbol: RET: Ensembl Transcript ID: EN5T00000355710.3: GRCh: 37: Chr: 10: [Target cancer mutation information]: mut start: 43612063: mut end: 43612063: mut class: Missense Mutation: mut type: SNP: ref seq: A: mut seq: G: mut aa: p.N723S: mutation info source: CCLE: ref target(-10 +10):
CCTCGGAAGAACTTGGTTCTT (SEQ ID NO: 849): mut target(-10 +10):
CCTCGGAAGAGCTTGGTTCTT (SEQ ID NO: 850): [Model Cell line information]: cell: HCC827GR5: cancer type: LUNG: PAM dist: 9: indel length: 0: CRISPR gRNA ID: GF-CCELg9-784: [crRNA sequence]: crRNA sequence: CGGTGCTCCCCGGGGACACCTGG (SEQ ID NO: 2761):
SpgRNA: attctaatacgactcactataggCGGTGCTCCCCGGGGACACCgttttagagctagaaatagcaagttaaaataaggctagtccgtt atcaacttgaaaaagtggcaccgagtcggtgc (SEQ ID NO: 2762): [Target gene information]: Gene ID: 5979: Symbol: RET: Ensembl Transcript ID: EN5T00000355710.3: GRCh: 37: Chr: 10: [Target cancer mutation information]: mut start: 43601908: mut end: 43601908: mut class: Missense Mutation: mut type: SNP: ref seq: C: mut seq: G: mut aa: p.L318V: mutation info source: CCLE: ref target(-10 +10):
CACAAGCACGCTGCTCCCCGG (SEQ ID NO: 2763): mut target(-10 +10):
CACAAGCACGGTGCTCCCCGG (SEQ ID NO: 2764): [Model Cell line information]: cell: NCIH1563: cancer type: LUNG: PAM dist: 18: indel length: 0: CRISPR gRNA ID: GF-CCELg9-785: [crRNA sequence]: crRNA sequence: TACACAAGCACGGTGCTCCCCGG (SEQ ID NO: 2765):

TABLE 7-continued

Illustrative guide RNA sequences for polypeptides comprising Cas9

SpgRNA: attctaatacgactcactataggTACACAAGCACGGTGCTCCCgttttagagctagaaatagcaagttaaaataaggctagtccgtt
atcaacttgaaaaagtggcaccgagtcggtgc (SEQ ID NO: 2766): [Target gene information]: Gene ID: 5979: Symbol:
RET: Ensembl Transcript ID: EN5T00000355710.3: GRCh: 37: Chr: 10: [Target cancer mutation
information]: mut start: 43601908: mut end: 43601908: mut class: Missense Mutation: mut type: SNP: ref
seq: C: mut seq: G: mut aa: p.L318V: mutation info source: CCLE: ref target(-10 +10):
CACAAGCACGCTGCTCCCCGG (SEQ ID NO: 2763): mut target(-10 +10):
CACAAGCACGGTGCTCCCCGG (SEQ ID NO: 2764): [Model Cell line information]: cell: NCIH1563:
cancer type: LUNG: PAM dist: 8: indel length: 0: CRISPR gRNA ID: GF-CCELg9-786: [crRNA sequence]:
crRNA sequence: ACACAAGCACGGTGCTCCCCGGG (SEQ ID NO: 2767):
SpgRNA: attctaatacgactcactataggACACAAGCACGGTGCTCCCCgttttagagctagaaatagcaagttaaaataaggctagtccgtt
atcaacttgaaaaagtggcaccgagtcggtgc (SEQ ID NO: 2768): [Target gene information]: Gene ID: 5979: Symbol:
RET: Ensembl Transcript ID: EN5T00000355710.3: GRCh: 37: Chr: 10: [Target cancer mutation
information]: mut start: 43601908: mut end: 43601908: mut class: Missense Mutation: mut type: SNP: ref
seq: C: mut seq: G: mut aa: p.L318V: mutation info source: CCLE: ref target(-10 +10):
CACAAGCACGCTGCTCCCCGG (SEQ ID NO: 2763): mut target(-10 +10):
CACAAGCACGGTGCTCCCCGG (SEQ ID NO: 2764): [Model Cell line information]: cell: NCIH1563:
cancer type: LUNG: PAM dist: 9: indel length: 0: CRISPR gRNA ID: GF-CCELg9-787: [crRNA sequence]:
crRNA sequence: CACAAGCACGGTGCTCCCCGGG (SEQ ID NO: 2769):
SpgRNA: attctaatacgactcactataggCACAAGCACGGTGCTCCCCGgttttagagctagaaatagcaagttaaaataaggctagtccgtt
atcaacttgaaaaagtggcaccgagtcggtgc (SEQ ID NO: 2770): [Target gene information]: Gene ID: 5979: Symbol:
RET: Ensembl Transcript ID: EN5T00000355710.3: GRCh: 37: Chr: 10: [Target cancer mutation
information]: mut start: 43601908: mut end: 43601908: mut class: Missense Mutation: mut type: SNP: ref
seq: C: mut seq: G: mut aa: p.L318V: mutation info source: CCLE: ref target(-10 +10):
CACAAGCACGCTGCTCCCCGG (SEQ ID NO: 2763): mut target(-10 +10):
CACAAGCACGGTGCTCCCCGG (SEQ ID NO: 2764): [Model Cell line information]: cell: NCIH1563:
cancer type: LUNG: PAM dist: 10: indel length: 0: CRISPR gRNA ID: GF-CCELg9-788: [crRNA sequence]:
crRNA sequence: GGTGCTCCCCGGGGACACCTGGG (SEQ ID NO: 2771):
SpgRNA: attctaatacgactcactataggGGTGCTCCCCGGGGACACCTgttttagagctagaaatagcaagttaaaataaggctagtccgtt
atcaacttgaaaaagtggcaccgagtcggtgc (SEQ ID NO: 2772): [Target gene information]: Gene ID: 5979: Symbol:
RET: Ensembl Transcript ID: EN5T00000355710.3: GRCh: 37: Chr: 10: [Target cancer mutation
information]: mut start: 43601908: mut end: 43601908: mut class: Missense Mutation: mut type: SNP: ref
seq: C: mut seq: G: mut aa: p.L318V: mutation info source: CCLE: ref target(-10 +10):
CACAAGCACGCTGCTCCCCGG (SEQ ID NO: 2763): mut target(-10 +10):
CACAAGCACGGTGCTCCCCGG (SEQ ID NO: 2764): [Model Cell line information]: cell: NCIH1563:
cancer type: LUNG: PAM dist: 19: indel length: 0: CRISPR gRNA ID: GF-CCELg9-789: [crRNA sequence]:
crRNA sequence: CCACCGACCAGCAGACGTCTAGG (SEQ ID NO: 2773):
SpgRNA: attctaatacgactcactataggCCACCGACCAGCAGACGTCTgttttagagctagaaatagcaagttaaaataaggctagtccgtt
atcaacttgaaaaagtggcaccgagtcggtgc (SEQ ID NO: 2774): [Target gene information]: Gene ID: 5979: Symbol:
RET: Ensembl Transcript ID: EN5T00000355710.3: GRCh: 37: Chr: 10: [Target cancer mutation
information]: mut start: 43606867: mut end: 43606867: mut class: Silent: mut type: SNP: ref seq: C: mut
seq: G: mut aa: p.T492T: mutation info source: CCLE: ref target(-10 +10):
ACCAGCAGACCTCTAGGCAGG (SEQ ID NO: 2775): mut target(-10 +10):
ACCAGCAGACGTCTAGGCAGG (SEQ ID NO: 2776): [Model Cell line information]: cell: NCIH1573:
cancer type: LUNG: PAM dist: 4: indel length: 0: CRISPR gRNA ID: GF-CCELg9-790: [crRNA sequence]:
crRNA sequence: CGACCAGCAGACGTCTAGGCAGG (SEQ ID NO: 2777):
SpgRNA: attctaatacgactcactataggCGACCAGCAGACGTCTAGGCgttttagagctagaaatagcaagttaaaataaggctagtccgt
tatcaacttgaaaaagtggcaccgagtcggtgc (SEQ ID NO: 2778): [Target gene information]: Gene ID: 5979: Symbol:
RET: Ensembl Transcript ID: EN5T00000355710.3: GRCh: 37: Chr: 10: [Target cancer mutation
information]: mut start: 43606867: mut end: 43606867: mut class: Silent: mut type: SNP: ref seq: C: mut
seq: G: mut aa: p.T492T: mutation info source: CCLE: ref target(-10 +10):
ACCAGCAGACCTCTAGGCAGG (SEQ ID NO: 2775): mut target(-10 +10):
ACCAGCAGACGTCTAGGCAGG (SEQ ID NO: 2776): [Model Cell line information]: cell: NCIH1573:
cancer type: LUNG: PAM dist: 8: indel length: 0: CRISPR gRNA ID: GF-CCELg9-791: [crRNA sequence]:
crRNA sequence: GCAGACGTCTAGGCAGGCCCAGG (SEQ ID NO: 2779):
SpgRNA: attctaatacgactcactataggGCAGACGTCTAGGCAGGCCCgttttagagctagaaatagcaagttaaaataaggctagtccgt
tatcaacttgaaaaagtggcaccgagtcggtgc (SEQ ID NO: 2780): [Target gene information]: Gene ID: 5979: Symbol:
RET: Ensembl Transcript ID: EN5T00000355710.3: GRCh: 37: Chr: 10: [Target cancer mutation
information]: mut start: 43606867: mut end: 43606867: mut class: Silent: mut type: SNP: ref seq: C: mut
seq: G: mut aa: p.T492T: mutation info source: CCLE: ref target(-10 +10):
ACCAGCAGACCTCTAGGCAGG (SEQ ID NO: 2775): mut target(-10 +10):
ACCAGCAGACGTCTAGGCAGG (SEQ ID NO: 2776): [Model Cell line information]: cell: NCIH1573:
cancer type: LUNG: PAM dist: 14: indel length: 0: CRISPR gRNA ID: GF-CCELg9-792: [crRNA sequence]:
crRNA sequence: GGGCCTGCCTAGACGTCTGCTGG (SEQ ID NO: 2781):
SpgRNA: attctaatacgactcactataggGGGCCTGCCTAGACGTCTGCgttttagagctagaaatagcaagttaaaataaggctagtccgtt
atcaacttgaaaaagtggcaccgagtcggtgc (SEQ ID NO: 2782): [Target gene information]: Gene ID: 5979: Symbol:
RET: Ensembl Transcript ID: EN5T00000355710.3: GRCh: 37: Chr: 10: [Target cancer mutation
information]: mut start: 43606867: mut end: 43606867: mut class: Silent: mut type: SNP: ref seq: C: mut
seq: G: mut aa: p.T492T: mutation info source: CCLE: ref target(-10 +10):
ACCAGCAGACCTCTAGGCAGG (SEQ ID NO: 2775): mut target(-10 +10):
ACCAGCAGACGTCTAGGCAGG (SEQ ID NO: 2776): [Model Cell line information]: cell: NCIH1573:
cancer type: LUNG: PAM dist: 7: indel length: 0: CRISPR gRNA ID: GF-CCELg9-793: [crRNA sequence]:
crRNA sequence: CCTAGACGTCTGCTGGTCGGTGG (SEQ ID NO: 2783):
SpgRNA: attctaatacgactcactataggCCTAGACGTCTGCTGGTCGGgttttagagctagaaatagcaagttaaaataaggctagtccgtt
atcaacttgaaaaagtggcaccgagtcggtgc (SEQ ID NO: 2784): [Target gene information]: Gene ID: 5979: Symbol:
RET: Ensembl Transcript ID: EN5T00000355710.3: GRCh: 37: Chr: 10: [Target cancer mutation
information]: mut start: 43606867: mut end: 43606867: mut class: Silent: mut type: SNP: ref seq: C: mut
seq: G: mut aa: p.T492T: mutation info source: CCLE: ref target(-10 +10):
ACCAGCAGACCTCTAGGCAGG (SEQ ID NO: 2775): mut target(-10 +10):

TABLE 7-continued

Illustrative guide RNA sequences for polypeptides comprising Cas9

ACCAGCAGACGTCTAGGCAGG (SEQ ID NO: 2776): [Model Cell line information]: cell: NCIH1573:
cancer type: LUNG: PAM dist: 14: indel length: 0: CRISPR gRNA ID: GF-CCELg9-794: [crRNA sequence]:
crRNA sequence: CTGCCTAGACGTCTGCTGGTCGG (SEQ ID NO: 2785):
SpgRNA: attctaatacgactcactataggCTGCCTAGACGTCTGCTGGTgttttagagctagaaatagcaagttaaaataaggctagtccgtt
atcaacttgaaaaagtggcaccgagtcggtgc (SEQ ID NO: 2786): [Target gene information]: Gene ID: 5979: Symbol:
RET: Ensembl Transcript ID: EN5T00000355710.3: GRCh: 37: Chr: 10: [Target cancer mutation
information]: mut start: 43606867: mut end: 43606867: mut class: Silent: mut type: SNP: ref seq: C: mut
seq: G: mut aa: p.T492T: mutation info source: CCLE: ref target(-10 +10):
ACCAGCAGACCTCTAGGCAGG (SEQ ID NO: 2775): mut target(-10 +10):
ACCAGCAGACGTCTAGGCAGG (SEQ ID NO: 2776): [Model Cell line information]: cell: NCIH1573:
cancer type: LUNG: PAM dist: 11: indel length: 0: CRISPR gRNA ID: GF-CCELg9-795: [crRNA sequence]:
crRNA sequence: CCCCGAAGGGCCTGCTGAGTTGG (SEQ ID NO: 2787):
SpgRNA: attctaatacgactcactataggCCCCGAAGGGCCTGCTGAGTgttttagagctagaaatagcaagttaaaataaggctagtccgtt
atcaacttgaaaaagtggcaccgagtcggtgc (SEQ ID NO: 2788): [Target gene information]: Gene ID: 54894:
Symbol: RNF43: Ensembl Transcript ID: EN5T00000584437.1: GRCh: 37: Chr: 17: [Target cancer mutation
information]: mut start: 56435323: mut end: 56435323: mut class: Missense Mutation: mut type: SNP: ref
seq: G: mut seq: C: mut aa: p.A605G: mutation info source: CCLE: ref target(-10 +10):
CCCCGAAGGGGCTGCTGAGTT (SEQ ID NO: 2789): mut target(-10 +10):
CCCCGAAGGGCCTGCTGAGTT (SEQ ID NO: 2790): [Model Cell line information]: cell: NCIH1573:
cancer type: LUNG: PAM dist: 10: indel length: 0: CRISPR gRNA ID: GF-CCELg9-796: [crRNA sequence]:
crRNA sequence: AGGGCCTGCTGAGTTGGATCTGG (SEQ ID NO: 2791):
SpgRNA: attctaatacgactcactataggAGGGCCTGCTGAGTTGGATCgttttagagctagaaatagcaagttaaaataaggctagtccgtt
atcaacttgaaaaagtggcaccgagtcggtgc (SEQ ID NO: 2792): [Target gene information]: Gene ID: 54894:
Symbol: RNF43: Ensembl Transcript ID: EN5T00000584437.1: GRCh: 37: Chr: 17: [Target cancer mutation
information]: mut start: 56435323: mut end: 56435323: mut class: Missense Mutation: mut type: SNP: ref
seq: G: mut seq: C: mut aa: p.A605G: mutation info source: CCLE: ref target(-10 +10):
CCCCGAAGGGGCTGCTGAGTT (SEQ ID NO: 2789): mut target(-10 +10):
CCCCGAAGGGCCTGCTGAGTT (SEQ ID NO: 2790): [Model Cell line information]: cell: NCIH1573:
cancer type: LUNG: PAM dist: 16: indel length: 0: CRISPR gRNA ID: GF-CCELg9-797: [crRNA sequence]:
crRNA sequence: ATCCAACTCAGCAGGCCCTTCGG (SEQ ID NO: 2793):
SpgRNA: attctaatacgactcactataggATCCAACTCAGCAGGCCCTTgttttagagctagaaatagcaagttaaaataaggctagtccgtt
atcaacttgaaaaagtggcaccgagtcggtgc (SEQ ID NO: 2794): [Target gene information]: Gene ID: 54894:
Symbol: RNF43: Ensembl Transcript ID: EN5T00000584437.1: GRCh: 37: Chr: 17: [Target cancer mutation
information]: mut start: 56435323: mut end: 56435323: mut class: Missense Mutation: mut type: SNP: ref
seq: G: mut seq: C: mut aa: p.A605G: mutation info source: CCLE: ref target(-10 +10):
CCCCGAAGGGGCTGCTGAGTT (SEQ ID NO: 2789): mut target(-10 +10):
CCCCGAAGGGCCTGCTGAGTT (SEQ ID NO: 2790): [Model Cell line information]: cell: NCIH1573:
cancer type: LUNG: PAM dist: 6: indel length: 0: CRISPR gRNA ID: GF-CCELg9-798: [crRNA sequence]:
crRNA sequence: ACTCAGCAGGCCCTTCGGGCGG (SEQ ID NO: 2795):
SpgRNA: attctaatacgactcactataggACTCAGCAGGCCCTTCGGGGgttttagagctagaaatagcaagttaaaataaggctagtccgtt
atcaacttgaaaaagtggcaccgagtcggtgc (SEQ ID NO: 2796): [Target gene information]: Gene ID: 54894:
Symbol: RNF43: Ensembl Transcript ID: EN5T00000584437.1: GRCh: 37: Chr: 17: [Target cancer mutation
information]: mut start: 56435323: mut end: 56435323: mut class: Missense Mutation: mut type: SNP: ref
seq: G: mut seq: C: mut aa: p.A605G: mutation info source: CCLE: ref target(-10 +10):
CCCCGAAGGGGCTGCTGAGTT (SEQ ID NO: 2789): mut target(-10 +10):
CCCCGAAGGGCCTGCTGAGTT (SEQ ID NO: 2790): [Model Cell line information]: cell: NCIH1573:
cancer type: LUNG: PAM dist: 11: indel length: 0: CRISPR gRNA ID: GF-CCELg9-799: [crRNA sequence]:
crRNA sequence: TCCAACTCAGCAGGCCCTTCGGG (SEQ ID NO: 2797):
SpgRNA: attctaatacgactcactataggTCCAACTCAGCAGGCCCTTCgttttagagctagaaatagcaagttaaaataaggctagtccgtt
atcaacttgaaaaagtggcaccgagtcggtgc (SEQ ID NO: 2798): [Target gene information]: Gene ID: 54894:
Symbol: RNF43: Ensembl Transcript ID: EN5T00000584437.1: GRCh: 37: Chr: 17: [Target cancer mutation
information]: mut start: 56435323: mut end: 56435323: mut class: Missense Mutation: mut type: SNP: ref
seq: G: mut seq: C: mut aa: p.A605G: mutation info source: CCLE: ref target(-10 +10):
CCCCGAAGGGGCTGCTGAGTT (SEQ ID NO: 2789): mut target(-10 +10):
CCCCGAAGGGCCTGCTGAGTT (SEQ ID NO: 2790): [Model Cell line information]: cell: NCIH1573:
cancer type: LUNG: PAM dist: 7: indel length: 0: CRISPR gRNA ID: GF-CCELg9-800: [crRNA sequence]:
crRNA sequence: CCAACTCAGCAGGCCCTTCGGGG (SEQ ID NO: 2799):
SpgRNA: attctaatacgactcactataggCCAACTCAGCAGGCCCTTCGgttttagagctagaaatagcaagttaaaataaggctagtccgtt
atcaacttgaaaaagtggcaccgagtcggtgc (SEQ ID NO: 2800): [Target gene information]: Gene ID: 54894:
Symbol: RNF43: Ensembl Transcript ID: EN5T00000584437.1: GRCh: 37: Chr: 17: [Target cancer mutation
information]: mut start: 56435323: mut end: 56435323: mut class: Missense Mutation: mut type: SNP: ref
seq: G: mut seq: C: mut aa: p.A605G: mutation info source: CCLE: ref target(-10 +10):
CCCCGAAGGGGCTGCTGAGTT (SEQ ID NO: 2789): mut target(-10 +10):
CCCCGAAGGGCCTGCTGAGTT (SEQ ID NO: 2790): [Model Cell line information]: cell: NCIH1573:
cancer type: LUNG: PAM dist: 8: indel length: 0: CRISPR gRNA ID: GF-CCELg9-801: [crRNA sequence]:
crRNA sequence: CTGAGAGCATTGGAATTGCTTGG (SEQ ID NO: 2801):
SpgRNA: attctaatacgactcactataggCTGAGAGCATTGGAATTGCTgttttagagctagaaatagcaagttaaaataaggctagtccgtt
atcaacttgaaaaagtggcaccgagtcggtgc (SEQ ID NO: 2802): [Target gene information]: Gene ID: 57521:
Symbol: RPTOR: Ensembl Transcript ID: EN5T00000306801.3: GRCh: 37: Chr: 17: [Target cancer mutation
information]: mut start: 78829302: mut end: 78829302: mut class: Missense Mutation: mut type: SNP: ref
seq: C: mut seq: A: mut aa: p.D451E: mutation info source: CCLE: ref target(-10 +10):
GAGCATTGGACTTGCTTGGAA (SEQ ID NO: 2803): mut target(-10 +10):
GAGCATTGGAATTGCTTGGAA (SEQ ID NO: 2804): [Model Cell line information]: cell: NCIH460:
cancer type: LUNG: PAM dist: 6: indel length: 0: CRISPR gRNA ID: GF-CCELg9-802: [crRNA sequence]:
crRNA sequence: GGAATTGCTTGGAAGATTTTGG (SEQ ID NO: 2805):
SpgRNA: attctaatacgactcactataggGGAATTGCTTGGAAGATTTTgttttagagctagaaatagcaagttaaaataaggctagtccgtt
atcaacttgaaaaagtggcaccgagtcggtgc (SEQ ID NO: 2806): [Target gene information]: Gene ID: 57521:
Symbol: RPTOR: Ensembl Transcript ID: EN5T00000306801.3: GRCh: 37: Chr: 17: [Target cancer mutation TABLE 7-continued Illustrative guide RNA sequences for polypeptides comprising Cas9 information]: mut start: 78829302: mut end: 78829302: mut class: Missense Mutation: mut type: SNP: ref
seq: C: mut seq: A: mut aa: p.D451E: mutation info source: CCLE: ref target(-10 +10):
GAGCATTGGACTTGCTTGGAA (SEQ ID NO: 2803): mut target(-10 +10):
GAGCATTGGAATTGCTTGGAA (SEQ ID NO: 2804): [Model Cell line information]: cell: NCIH460:
cancer type: LUNG: PAM dist: 17: indel length: 0: CRISPR gRNA ID: GF-CCELg9-803: [crRNA sequence]:
crRNA sequence: GCAATTCCAATGCTCTCAGCCGG (SEQ ID NO: 2807):
SpgRNA: attctaatacgactcactataggGCAATTCCAATGCTCTCAGCgttttagagctagaaatagcaagttaaaataaggctagtccgtt
atcaacttgaaaaagtggcaccgagtcggtgc (SEQ ID NO: 2808): [Target gene information]: Gene ID: 57521:
Symbol: RPTOR: Ensembl Transcript ID: EN5T00000306801.3: GRCh: 37: Chr: 17: [Target cancer mutation
information]: mut start: 78829302: mut end: 78829302: mut class: Missense Mutation: mut type: SNP: ref
seq: C: mut seq: A: mut aa: p.D451E: mutation info source: CCLE: ref target(-10 +10):
GAGCATTGGACTTGCTTGGAA (SEQ ID NO: 2803): mut target(-10 +10):
GAGCATTGGAATTGCTTGGAA (SEQ ID NO: 2804): [Model Cell line information]: cell: NCIH460:
cancer type: LUNG: PAM dist: 16: indel length: 0: CRISPR gRNA ID: GF-CCELg9-804: [crRNA sequence]:
crRNA sequence: GTCCACCATGGAGAACTGGTAGG (SEQ ID NO: 2809):
SpgRNA: attctaatacgactcactataggGTCCACCATGGAGAACTGGTgttttagagctagaaatagcaagttaaaataaggctagtccgtt
atcaacttgaaaaagtggcaccgagtcggtgc (SEQ ID NO: 2810): [Target gene information]: Gene ID: 861: Symbol:
RUNX1: Ensembl Transcript ID: ENST00000344691.4: GRCh: 37: Chr: 21: [Target cancer mutation
information]: mut start: 36164616: mut end: 36164616: mut class: Missense Mutation: mut type: SNP: ref
seq: C: mut seq: T: mut aa: p.G393D: mutation info source: CCLE: ref target(-10 +10):
GCGCTCGCCGCCCACCATGGA (SEQ ID NO: 2811): mut target(-10 +10):
GCGCTCGCCGTCCACCATGGA (SEQ ID NO: 2812): [Model Cell line information]: cell: HPAFII:
cancer type: PANCREAS: PAM dist: 19: indel length: 0: CRISPR gRNA ID: GF-CCELg9-805: [crRNA
sequence]: crRNA sequence: CGAGCGCTCGCCGTCCACCATGG (SEQ ID NO: 2813):
SpgRNA: attctaatacgactcactataggCGAGCGCTCGCCGTCCACCAgttttagagctagaaatagcaagttaaaataaggctagtccgtt
atcaacttgaaaaagtggcaccgagtcggtgc (SEQ ID NO: 2814): [Target gene information]: Gene ID: 861: Symbol:
RUNX1: Ensembl Transcript ID: EN5T00000344691.4: GRCh: 37: Chr: 21: [Target cancer mutation
information]: mut start: 36164616: mut end: 36164616: mut class: Missense Mutation: mut type: SNP: ref
seq: C: mut seq: T: mut aa: p.G393D: mutation info source: CCLE: ref target(-10 +10):
GCGCTCGCCGCCCACCATGGA (SEQ ID NO: 2811): mut target(-10 +10):
GCGCTCGCCGTCCACCATGGA (SEQ ID NO: 2812): [Model Cell line information]: cell: HPAFII:
cancer type: PANCREAS: PAM dist: 7: indel length: 0: CRISPR gRNA ID: GF-CCELg9-806: [crRNA
sequence]: crRNA sequence: CGCCGTCCACCATGGAGAACTGG (SEQ ID NO: 2815):
SpgRNA: attctaatacgactcactataggCGCCGTCCACCATGGAGAACgttttagagctagaaatagcaagttaaaataaggctagtccgtt
atcaacttgaaaaagtggcaccgagtcggtgc (SEQ ID NO: 2816): [Target gene information]: Gene ID: 861: Symbol:
RUNX1: Ensembl Transcript ID: EN5T00000344691.4: GRCh: 37: Chr: 21: [Target cancer mutation
information]: mut start: 36164616: mut end: 36164616: mut class: Missense Mutation: mut type: SNP: ref
seq: C: mut seq: T: mut aa: p.G393D: mutation info source: CCLE: ref target(-10 +10):
GCGCTCGCCGCCCACCATGGA (SEQ ID NO: 2811): mut target(-10 +10):
GCGCTCGCCGTCCACCATGGA (SEQ ID NO: 2812): [Model Cell line information]: cell: HPAFII:
cancer type: PANCREAS: PAM dist: 15: indel length: 0: CRISPR gRNA ID: GF-CCELg9-807: [crRNA
sequence]: crRNA sequence: TACCAGTTCTCCATGGTGGACGG (SEQ ID NO: 2817):
SpgRNA: attctaatacgactcactataggTACCAGTTCTCCATGGTGGAgttttagagctagaaatagcaagttaaaataaggctagtccgtt
atcaacttgaaaaagtggcaccgagtcggtgc (SEQ ID NO: 2818): [Target gene information]: Gene ID: 861: Symbol:
RUNX1: Ensembl Transcript ID: EN5T00000344691.4: GRCh: 37: Chr: 21: [Target cancer mutation
information]: mut start: 36164616: mut end: 36164616: mut class: Missense Mutation: mut type: SNP: ref
seq: C: mut seq: T: mut aa: p.G393D: mutation info source: CCLE: ref target(-10 +10):
GCGCTCGCCGCCCACCATGGA (SEQ ID NO: 2811): mut target(-10 +10):
GCGCTCGCCGTCCACCATGGA (SEQ ID NO: 2812): [Model Cell line information]: cell: HPAFII:
cancer type: PANCREAS: PAM dist: 1: indel length: 0: CRISPR gRNA ID: GF-CCELg9-808: [crRNA
sequence]: crRNA sequence: GTATTTTTGTTGGTAACACTAGG (SEQ ID NO: 2819):
SpgRNA: attctaatacgactcactataggGTATTTTTGTTGGTAACACTAgttttagagctagaaatagcaagttaaaataaggctagtccgtta
tcaacttgaaaaagtggcaccgagtcggtgc (SEQ ID NO: 2820): [Target gene information]: Gene ID: 23429: Symbol:
RYBP: Ensembl Transcript ID: EN5T00000477973.2: GRCh: 37: Chr: 3: [Target cancer mutation
information]: mut start: 72428425: mut end: 72428425: mut class: Missense Mutation: mut type: SNP: ref
seq: C: mut seq: G: mut aa: p.E193Q: mutation info source: CCLE: ref target(-10 +10):
TGGTATTTTTCTTGGTAACAC (SEQ ID NO: 875): mut target(-10 +10):
TGGTATTTTTGTTGGTAACAC (SEQ ID NO: 876): [Model Cell line information]: cell: NCIH1563:
cancer type: LUNG: PAM dist: 12: indel length: 0: CRISPR gRNA ID: GF-CCELg9-809: [crRNA sequence]:
crRNA sequence: TTTCTTGTTGGTATTTTTGTTGG (SEQ ID NO: 2821):
SpgRNA: attctaatacgactcactataggTTTCTTGTTGGTATTTTTGTgttttagagctagaaatagcaagttaaaataaggctagtccgttat
caacttgaaaaagtggcaccgagtcggtgc (SEQ ID NO: 2822): [Target gene information]: Gene ID: 23429: Symbol:
RYBP: Ensembl Transcript ID: EN5T00000477973.2: GRCh: 37: Chr: 3: [Target cancer mutation
information]: mut start: 72428425: mut end: 72428425: mut class: Missense Mutation: mut type: SNP: ref
seq: C: mut seq: G: mut aa: p.E193Q: mutation info source: CCLE: ref target(-10 +10):
TGGTATTTTTCTTGGTAACAC (SEQ ID NO: 875): mut target(-10 +10):
TGGTATTTTTGTTGGTAACAC (SEQ ID NO: 876): [Model Cell line information]: cell: NCIH1563:
cancer type: LUNG: PAM dist: 2: indel length: 0: CRISPR gRNA ID: GF-CCELg9-810: [crRNA sequence]:
crRNA sequence: TATTGCACACCTTACATGGAAGG (SEQ ID NO: 2823):
SpgRNA: attctaatacgactcactataggTATTGCACACCTTACATGGAgttttagagctagaaatagcaagttaaaataaggctagtccgtt
atcaacttgaaaaagtggcaccgagtcggtgc (SEQ ID NO: 2824): [Target gene information]: Gene ID: 6389: Symbol:
SDHA: Ensembl Transcript ID: EN5T00000264932.6: GRCh: 37: Chr: 5: [Target cancer mutation
information]: mut start: 226154: mut end: 226154: mut class: Missense Muta-
tion: mut type: SNP: ref seq: T:
mut seq: C: mut aa: p.Y205H: mutation info source: CCLE: ref target(-10 +10):
GCACACCTTATATGGAAGGGT (SEQ ID NO: 2825): mut target(-10 +10):
GCACACCTTACATGGAAGGGT (SEQ ID NO: 2826): [Model Cell line information]: cell: NCIH2126:

TABLE 7-continued

Illustrative guide RNA sequences for polypeptides comprising Cas9 cancer type: LUNG: PAM dist: 6: indel length: 0: CRISPR gRNA ID: GF-CCELg9-811: [crRNA sequence]:
crRNA sequence: ACACCTTAC̲ATGGAAGGGTAAGG (SEQ ID NO: 2827):
SpgRNA: attctaatacgactcactataggACACCTTACATGGAAGGGTAgttttagagctagaaatagcaagttaaaataaggctagtccgtt
atcaacttgaaaaagtggcaccgagtcggtgc (SEQ ID NO: 2828): [Target gene information]: Gene ID: 6389: Symbol:
SDHA: Ensembl Transcript ID: EN5T00000264932.6: GRCh: 37: Chr: 5: [Target cancer mutation
information]: mut start: 226154: mut end: 226154: mut class: Missense Muta-
tion: mut type: SNP: ref seq: T:
mut seq: C: mut aa: p.Y205H: mutation info source: CCLE: ref target(-10 +10):
GCACACCTTAT̲ATGGAAGGGT (SEQ ID NO: 2825): mut target(-10 +10):
GCACACCTTAC̲ATGGAAGGGT (SEQ ID NO: 2826): [Model Cell line information]: cell: NCIH2126:
cancer type: LUNG: PAM dist: 12: indel length: 0: CRISPR gRNA ID: GF-CCELg9-812: [crRNA sequence]:
crRNA sequence: TCGCTATTGCACACCTTAC̲ATGG (SEQ ID NO: 2829):
SpgRNA: attctaatacgactcactataggTCGCTATTGCACACCTTACAgttttagagctagaaatagcaagttaaaataaggctagtccgtt
atcaacttgaaaaagtggcaccgagtcggtgc (SEQ ID NO: 283 0): [Target gene information]: Gene ID: 6389: Symbol:
SDHA: Ensembl Transcript ID: EN5T00000264932.6: GRCh: 37: Chr: 5: [Target cancer mutation
information]: mut start: 226154: mut end: 226154: mut class: Missense Muta-
tion: mut type: SNP: ref seq: T:
mut seq: C: mut aa: p.Y205H: mutation info source: CCLE: ref target(-10 +10):
GCACACCTTAT̲ATGGAAGGGT (SEQ ID NO: 2825): mut target(-10 +10):
GCACACCTTAC̲ATGGAAGGGT (SEQ ID NO: 2826): [Model Cell line information]: cell: NCIH2126:
cancer type: LUNG: PAM dist: 2: indel length: 0: CRISPR gRNA ID: GF-CCELg9-813: [crRNA sequence]:
crRNA sequence: ATTGCACACCTTAC̲ATGGAAGGG (SEQ ID NO: 2831):
SpgRNA: attctaatacgactcactataggATTGCACACCTTACATGGAAgttttagagctagaaatagcaagttaaaataaggctagtccgtt
atcaacttgaaaaagtggcaccgagtcggtgc (SEQ ID NO: 283 2): [Target gene information]: Gene ID: 6389: Symbol:
SDHA: Ensembl Transcript ID: EN5T00000264932.6: GRCh: 37: Chr: 5: [Target cancer mutation
information]: mut start: 226154: mut end: 226154: mut class: Missense Muta-
tion: mut type: SNP: ref seq: T:
mut seq: C: mut aa: p.Y205H: mutation info source: CCLE: ref target(-10 +10):
GCACACCTTAT̲ATGGAAGGGT (SEQ ID NO: 2825): mut target(-10 +10):
GCACACCTTAC̲ATGGAAGGGT (SEQ ID NO: 2826): [Model Cell line information]: cell: NCIH2126:
cancer type: LUNG: PAM dist: 7: indel length: 0: CRISPR gRNA ID: GF-CCELg9-814: [crRNA sequence]:
crRNA sequence: CGGCCTTACCCTTCCATG̲TAAGG (SEQ ID NO: 2833):
SpgRNA: attctaatacgactcactataggCGGCCTTACCCTTCCATGTAgttttagagctagaaatagcaagttaaaataaggctagtccgtta
tcaacttgaaaaagtggcaccgagtcggtgc (SEQ ID NO: 2834): [Target gene information]: Gene ID: 6389: Symbol:
SDHA: Ensembl Transcript ID: EN5T00000264932.6: GRCh: 37: Chr: 5: [Target cancer mutation
information]: mut start: 226154: mut end: 226154: mut class: Missense Muta-
tion: mut type: SNP: ref seq: T:
mut seq: C: mut aa: p.Y205H: mutation info source: CCLE: ref target(-10 +10):
GCACACCTTAT̲ATGGAAGGGT (SEQ ID NO: 2825): mut target(-10 +10):
GCACACCTTAC̲ATGGAAGGGT (SEQ ID NO: 2826): [Model Cell line information]: cell: NCIH2126:
cancer type: LUNG: PAM dist: 3: indel length: 0: CRISPR gRNA ID: GF-CCELg9-815: [crRNA sequence]:
crRNA sequence: G̲TAAGGTGTGCAATAGCGAGTGG (SEQ ID NO: 2835):
SpgRNA: attctaatacgactcactataggGTAAGGTGTGCAATAGCGAGgttttagagctagaaatagcaagttaaaataaggctagtccgt
tatcaacttgaaaaagtggcaccgagtcggtgc (SEQ ID NO: 283 6): [Target gene information]: Gene ID: 6389: Symbol:
SDHA: Ensembl Transcript ID: ENST00000264932.6: GRCh: 37: Chr: 5: [Target cancer mutation
information]: mut start: 226154: mut end: 226154: mut class: Missense Muta-
tion: mut type: SNP: ref seq: T:
mut seq: C: mut aa: p.Y205H: mutation info source: CCLE: ref target(-10 +10):
GCACACCTTAT̲ATGGAAGGGT (SEQ ID NO: 2825): mut target(-10 +10):
GCACACCTTAC̲ATGGAAGGGT (SEQ ID NO: 2 826): [Model Cell line information]: cell: NCIH2126:
cancer type: LUNG: PAM dist: 20: indel length: 0: CRISPR gRNA ID: GF-CCELg9-816: [crRNA sequence]:
crRNA sequence: TTTTTCTTT̲ATGGGGCTTTCAGG (SEQ ID NO: 2837):
SpgRNA: attctaatacgactcactataggTTTTTCTTTATGGGGCTTTCgttttagagctagaaatagcaagttaaaataaggctagtccgttat
caacttgaaaaagtggcaccgagtcggtgc (SEQ ID NO: 2838): [Target gene information]: Gene ID: 4068: Symbol:
SH2D1A: Ensembl Transcript ID: ENST00000371139.4: GRCh: 37: Chr: X: [Target cancer mutation
information]: mut start: 123505240: mut end: 123505240: mut class: Silent: mut type: SNP: ref seq: G: mut
seq: A: mut aa: p.*129*: mutation info source: CCLE: ref target(-10 +10):
AAAGCCCCATG̲AAGAAAAATA (SEQ ID NO: 887): mut target(-10 +10):
AAAGCCCCATA̲AAGAAAAATA (SEQ ID NO: 888): [Model Cell line information]: cell: NCIH661:
cancer type: LUNG: PAM dist: 12: indel length: 0: CRISPR gRNA ID: GF-CCELg9-817: [crRNA sequence]:
crRNA sequence: AGGTGTTTTATTTTTCTTT̲ATGG (SEQ ID NO: 2839):
SpgRNA: attctaatacgactcactataggAGGTGTTTTATTTTTCTTTAgttttagagctagaaatagcaagttaaaataaggctagtccgttat
caacttgaaaaagtggcaccgagtcggtgc (SEQ ID NO: 2840): [Target gene information]: Gene ID: 4068: Symbol:
SH2D1A: Ensembl Transcript ID: ENST00000371139.4: GRCh: 37: Chr: X: [Target cancer mutation
information]: mut start: 123505240: mut end: 123505240: mut class: Silent: mut type: SNP: ref seq: G: mut
seq: A: mut aa: p.*129*: mutation info source: CCLE: ref target(-10 +10):
AAAGCCCCATG̲AAGAAAAATA (SEQ ID NO: 887): mut target(-10 +10):
AAAGCCCCATA̲AAGAAAAATA (SEQ ID NO: 888): [Model Cell line information]: cell: NCIH661:
cancer type: LUNG: PAM dist: 2: indel length: 0: CRISPR gRNA ID: GF-CCELg9-818: [crRNA sequence]:
crRNA sequence: GGTGTTTTATTTTTCTTT̲ATGGG (SEQ ID NO: 2841):
SpgRNA: attctaatacgactcactataggGGTGTTTTATTTTTCTTTATgttttagagctagaaatagcaagttaaaataaggctagtccgttat
caacttgaaaaagtggcaccgagtcggtgc (SEQ ID NO: 2842): [Target gene information]: Gene ID: 4068: Symbol:
SH2D1A: Ensembl Transcript ID: ENST00000371139.4: GRCh: 37: Chr: X: [Target cancer mutation
information]: mut start: 123505240: mut end: 123505240: mut class: Silent: mut type: SNP: ref seq: G: mut
seq: A: mut aa: p.*129*: mutation info source: CCLE: ref target(-10 +10):
AAAGCCCCATG̲AAGAAAAATA (SEQ ID NO: 887): mut target(-10 +10):

TABLE 7-continued

Illustrative guide RNA sequences for polypeptides comprising Cas9

AAAGCCCCATAAAGAAAAATA (SEQ ID NO: 888): [Model Cell line information]: cell: NCIH661:
cancer type: LUNG: PAM dist: 3: indel length: 0: CRISPR gRNA ID: GF-CCELg9-819: [crRNA sequence]:
crRNA sequence: GTGTTTTATTTTTCTTTATGGGG (SEQ ID NO: 2843):
SpgRNA: attctaatacgactcactataggGTGTTTTATTTTTCTTTATGgttttagagctagaaatagcaagttaaaataaggctagtccgttat
caacttgaaaaagtggcaccgagtcggtgc (SEQ ID NO: 2844): [Target gene information]: Gene ID: 4068: Symbol:
SH2D1A: Ensembl Transcript ID: ENST00000371139.4: GRCh: 37: Chr: X: [Target cancer mutation
information]: mut start: 123505240: mut end: 123505240: mut class: Silent: mut type: SNP: ref seq: G: mut
seq: A: mut aa: p.*129*: mutation info source: CCLE: ref target(-10 +10):
AAAGCCCCATGAAGAAAAATA (SEQ ID NO: 887): mut target(-10 +10):
AAAGCCCCATAAAGAAAAATA (SEQ ID NO: 888): [Model Cell line information]: cell: NCIH661:
cancer type: LUNG: PAM dist: 4: indel length: 0: CRISPR gRNA ID: GF-CCELg9-820: [crRNA sequence]:
crRNA sequence: GCTCGGCCTGTACCTCCAGTCGG (SEQ ID NO: 2845):
SpgRNA: attctaatacgactcactataggGCTCGGCCTGTACCTCCAGTgttttagagctagaaatagcaagttaaaataaggctagtccgtt
atcaacttgaaaaagtggcaccgagtcggtgc (SEQ ID NO: 2846): [Target gene information]: Gene ID: 6597: Symbol:
SMARCA4: Ensembl Transcript ID: EN5T00000429416.3: GRCh: 37: Chr: 19: [Target cancer mutation
information]: mut start: 11141513: mut end: 11141513: mut class: Missense Mutation: mut type: SNP: ref
seq: A: mut seq: T: mut aa: p.N1164Y: mutation info source: CCLE: ref target(-10 +10):
GCTCGGCCTGAACCTCCAGTC (SEQ ID NO: 2847): mut target(-10 +10):
GCTCGGCCTGTACCTCCAGTC (SEQ ID NO: 2848): [Model Cell line information]: cell: NCIH1650:
cancer type: LUNG: PAM dist: 10: indel length: 0: CRISPR gRNA ID: GF-CCELg9-821: [crRNA sequence]:
crRNA sequence: TGTCTGCCGACTGGAGGTACAGG (SEQ ID NO: 2849):
SpgRNA: attctaatacgactcactataggTGTCTGCCGACTGGAGGTACgttttagagctagaaatagcaagttaaaataaggctagtccgtt
atcaacttgaaaaagtggcaccgagtcggtgc (SEQ ID NO: 2850): [Target gene information]: Gene ID: 6597: Symbol:
SMARCA4: Ensembl Transcript ID: EN5T00000429416.3: GRCh: 37: Chr: 19: [Target cancer mutation
information]: mut start: 11141513: mut end: 11141513: mut class: Missense Mutation: mut type: SNP: ref
seq: A: mut seq: T: mut aa: p.N1164Y: mutation info source: CCLE: ref target(-10 +10):
GCTCGGCCTGAACCTCCAGTC (SEQ ID NO: 2847): mut target(-10 +10):
GCTCGGCCTGTACCTCCAGTC (SEQ ID NO: 2848): [Model Cell line information]: cell: NCIH1650:
cancer type: LUNG: PAM dist: 2: indel length: 0: CRISPR gRNA ID: GF-CCELg9-822: [crRNA sequence]:
crRNA sequence: ACAGGCCGAGCCCCCCAGCCGG (SEQ ID NO: 2851):
SpgRNA: attctaatacgactcactataggACAGGCCGAGCCCCCCAGCCgttttagagctagaaatagcaagttaaaataaggctagtccgt
tatcaacttgaaaaagtggcaccgagtcggtgc (SEQ ID NO: 2852): [Target gene information]: Gene ID: 6597: Symbol:
SMARCA4: Ensembl Transcript ID: ENST00000429416.3: GRCh: 37: Chr: 19: [Target cancer mutation
information]: mut start: 11141513: mut end: 11141513: mut class: Missense Mutation: mut type: SNP: ref
seq: A: mut seq: T: mut aa: p.N1164Y: mutation info source: CCLE: ref target(-10 +10):
GCTCGGCCTGAACCTCCAGTC (SEQ ID NO: 2847): mut target(-10 +10):
GCTCGGCCTGTACCTCCAGTC (SEQ ID NO: 2848): [Model Cell line information]: cell: NCIH1650:
cancer type: LUNG: PAM dist: 20: indel length: 0: CRISPR gRNA ID: GF-CCELg9-823: [crRNA sequence]:
crRNA sequence: CACGCTGGAGTAGATCGAAGAGG (SEQ ID NO: 2853):
SpgRNA: attctaatacgactcactataggCACGCTGGAGTAGATCGAAGAGgttttagagctagaaatagcaagttaaaataaggctagtccgt
tatcaacttgaaaaagtggcaccgagtcggtgc (SEQ ID NO: 2854): [Target gene information]: Gene ID: 6597: Symbol:
SMARCA4: Ensembl Transcript ID: EN5T00000429416.3: GRCh: 37: Chr: 19: [Target cancer mutation
information]: mut start: 11152007: mut end: 11152007: mut class: Nonsense Mutation: mut type: SNP: ref
seq: G: mut seq: T: mut aa: p.E1399*: mutation info source: CCLE: ref target(-10 +10):
CACGCTGGAGGAGATCGAAGA (SEQ ID NO: 2855): mut target(-10 +10):
CACGCTGGAGTAGATCGAAGA (SEQ ID NO: 2856): [Model Cell line information]: cell: NCIH1573:
cancer type: LUNG: PAM dist: 10: indel length: 0: CRISPR gRNA ID: GF-CCELg9-824: [crRNA sequence]:
crRNA sequence: GCTGGAGTAGATCGAAGAGGAGG (SEQ ID NO: 2857):
SpgRNA: attctaatacgactcactataggGCTGGAGTAGATCGAAGAGGgttttagagctagaaatagcaagttaaaataaggctagtccgt
tatcaacttgaaaaagtggcaccgagtcggtgc (SEQ ID NO: 2858): [Target gene information]: Gene ID: 6597: Symbol:
SMARCA4: Ensembl Transcript ID: EN5T00000429416.3: GRCh: 37: Chr: 19: [Target cancer mutation
information]: mut start: 11152007: mut end: 11152007: mut class: Nonsense Mutation: mut type: SNP: ref
seq: G: mut seq: T: mut aa: p.E1399*: mutation info source: CCLE: ref target(-10 +10):
CACGCTGGAGGAGATCGAAGA (SEQ ID NO: 2855): mut target(-10 +10):
CACGCTGGAGTAGATCGAAGA (SEQ ID NO: 2856): [Model Cell line information]: cell: NCIH1573:
cancer type: LUNG: PAM dist: 13: indel length: 0: CRISPR gRNA ID: GF-CCELg9-825: [crRNA sequence]:
crRNA sequence: AGTAGATCGAAGAGGAGGTCCGG (SEQ ID NO: 2859):
SpgRNA: attctaatacgactcactataggAGTAGATCGAAGAGGAGGTCgttttagagctagaaatagcaagttaaaataaggctagtccgt
tatcaacttgaaaaagtggcaccgagtcggtgc (SEQ ID NO: 2860): [Target gene information]: Gene ID: 6597: Symbol:
SMARCA4: Ensembl Transcript ID: EN5T00000429416.3: GRCh: 37: Chr: 19: [Target cancer mutation
information]: mut start: 11152007: mut end: 11152007: mut class: Nonsense Mutation: mut type: SNP: ref
seq: G: mut seq: T: mut aa: p.E1399*: mutation info source: CCLE: ref target(-10 +10):
CACGCTGGAGGAGATCGAAGA (SEQ ID NO: 2855): mut target(-10 +10):
CACGCTGGAGTAGATCGAAGA (SEQ ID NO: 2856): [Model Cell line information]: cell: NCIH1573:
cancer type: LUNG: PAM dist: 18: indel length: 0: CRISPR gRNA ID: GF-CCELg9-826: [crRNA sequence]:
crRNA sequence: TGCAGATCAAAGGTTTGGAGAGG (SEQ ID NO: 2861):
SpgRNA: attctaatacgactcactataggTGCAGATCAAAGGTTTGGAGgttttagagctagaaatagcaagttaaaataaggctagtccgtt
atcaacttgaaaaagtggcaccgagtcggtgc (SEQ ID NO: 2862): [Target gene information]: Gene ID: 6597: Symbol:
SMARCA4: Ensembl Transcript ID: EN5T00000429416.3: GRCh: 37: Chr: 19: [Target cancer mutation
information]: mut start: 11123640: mut end: 11123640: mut class: Missense Mutation: mut type: SNP: ref
seq: T: mut seq: A: mut aa: p.W764R: mutation info source: CCLE: ref target(-10 +10):
AGGTTTGGAGTGGCTGGTGTC (SEQ ID NO: 901): mut target(-10 +10):
AGGTTTGGAGAGGCTGGTGTC (SEQ ID NO: 902): [Model Cell line information]: cell: NCIH2126:
cancer type: LUNG: PAM dist: 0: indel length: 0: CRISPR gRNA ID: GF-CCELg9-827: [crRNA sequence]:
crRNA sequence: GATCAAAGGTTTGGAGAGGCTGG (SEQ ID NO: 2863):
SpgRNA: attctaatacgactcactataggGATCAAAGGTTTGGAGAGGCgttttagagctagaaatagcaagttaaaataaggctagtccgt
tatcaacttgaaaaagtggcaccgagtcggtgc (SEQ ID NO: 2864): [Target gene information]: Gene ID: 6597: Symbol:
SMARCA4: Ensembl Transcript ID: EN5T00000429416.3: GRCh: 37: Chr: 19: [Target cancer mutation

TABLE 7-continued

Illustrative guide RNA sequences for polypeptides comprising Cas9 information]: mut start: 11123640: mut end: 11123640: mut class: Missense Mutation: mut type: SNP: ref
seq: T: mut seq: A: mut aa: p.W764R: mutation info source: CCLE: ref target(-10 +10):
AGGTTTGGAGTGGCTGGTGTC (SEQ ID NO: 901): mut target(-10 +10):
AGGTTTGGAGAGGCTGGTGTC (SEQ ID NO: 902): [Model Cell line information]: cell: NCIH2126:
cancer type: LUNG: PAM dist: 4: indel length: 0: CRISPR gRNA ID: GF-CCELg9-828: [crRNA sequence]:
crRNA sequence: CTATGCTGTCACTGAGAGAGTGG (SEQ ID NO: 2865):
SpgRNA: attctaatacgactcactataggCTATGCTGTCACTGAGAGAGgttttagagctagaaatagcaagttaaaataaggctagtccgtt
atcaacttgaaaaagtggcaccgagtcggtgc (SEQ ID NO: 2866): [Target gene information]: Gene ID: 6597: Symbol:
SMARCA4: Ensembl Transcript ID: EN5T00000429416.3: GRCh: 37: Chr: 19: [Target cancer mutation
information]: mut start: 11121117: mut end: 11121139: mut class: Frame Shift Del: mut type: DEL: ref seq:
GCAGTCCTACTATGCCGTGGCCC (SEQ ID NO: 2867): mut seq: -: mut aa: p.QSYYAVAH729fs
("QSYYAVAH" disclosed as SEQ ID NO: 2868): mutation info source: CCLE: ref target(-10 +10):
CACGTGGCCTGCAGTCCTACTATGCCGTGGCCCATGCTGTCAC (SEQ ID NO: 2869): mut target(-
10 +10): CACGTGGCCT-----------------------ATGCTGTCAC (SEQ ID NO: 2870): [Model Cell line
information]: cell: A549: cancer type: LUNG: PAM dist: 19: indel length: 23: CRISPR gRNA ID: GF-
CCELg9-829: [crRNA sequence]: crRNA sequence: CACTCTCTCAGTGACAGCATAGG (SEQ ID NO:
2871):
SpgRNA: attctaatacgactcactataggCACTCTCTCAGTGACAGCATg agagctagaaatagcaagttaaaataaggctagtccgtt
atcaacttgaaaaagtggcaccgagtcggtgc (SEQ ID NO: 2872): [Target gene information]: Gene ID: 6597: Symbol:
SMARCA4: Ensembl Transcript ID: ENST00000429416.3: GRCh: 37: Chr: 19: [Target cancer mutation
information]: mut start: 11121117: mut end: 11121139: mut class: Frame Shift Del: mut type: DEL: ref seq:
GCAGTCCTACTATGCCGTGGCCC (SEQ ID NO: 2867): mut seq: -: mut aa: p.QSYYAVAH729fs
("QSYYAVAH" disclosed as SEQ ID NO: 2868): mutation info source: CCLE: ref target(-10 +10):
CACGTGGCCTGCAGTCCTACTATGCCGTGGCCCATGCTGTCAC (SEQ ID NO: 2869): mut target(-
10 +10): CACGTGGCCT-----------------------ATGCTGTCAC (SEQ ID NO: 2870): [Model Cell line
information]: cell: A549: cancer type: LUNG: PAM dist: 1: indel length: 23: CRISPR gRNA ID: GF-
CCELg9-830: [crRNA sequence]: crRNA sequence: GACAGCATAGGCCACGTGCAAGG (SEQ ID NO:
2873):
SpgRNA: attctaatacgactcactataggGACAGCATAGGCCACGTGCAgttttagagctagaaatagcaagttaaaataaggctagtccgt
tatcaacttgaaaaagtggcaccgagtcggtgc (SEQ ID NO: 2874): [Target gene information]: Gene ID: 6597: Symbol:
SMARCA4: Ensembl Transcript ID: EN5T00000429416.3: GRCh: 37: Chr: 19: [Target cancer mutation
information]: mut start: 11121117: mut end: 11121139: mut class: Frame Shift Del: mut type: DEL: ref seq:
GCAGTCCTACTATGCCGTGGCCC (SEQ ID NO: 2867): mut seq: -: mut aa: p.QSYYAVAH729fs
("QSYYAVAH" disclosed as SEQ ID NO: 2868): mutation info source: CCLE: ref target(-10 +10):
CACGTGGCCTGCAGTCCTACTATGCCGTGGCCCATGCTGTCAC (SEQ ID NO: 2869): mut target(-
10 +10): CACGTGGCCT-----------------------ATGCTGTCAC (SEQ ID NO: 2870): [Model Cell line
information]: cell: A549: cancer type: LUNG: PAM dist: 13: indel length: 23: CRISPR gRNA ID: GF-
CCELg9-831: [crRNA sequence]: crRNA sequence: ATAGGCCACGTGCAAGGGCCTGG (SEQ ID NO:
2875):
SpgRNA: attctaatacgactcactataggATAGGCCACGTGCAAGGGCCgttttagagctagaaatagcaagttaaaataaggctagtccgtt
atcaacttgaaaaagtggcaccgagtcggtgc (SEQ ID NO: 2876): [Target gene information]: Gene ID: 6597: Symbol:
SMARCA4: Ensembl Transcript ID: EN5T00000429416.3: GRCh: 37: Chr: 19: [Target cancer mutation
information]: mut start: 11121117: mut end: 11121139: mut class: Frame Shift Del: mut type: DEL: ref seq:
GCAGTCCTACTATGCCGTGGCCC (SEQ ID NO: 2867): mut seq: -: mut aa: p.QSYYAVAH729fs
("QSYYAVAH" disclosed as SEQ ID NO: 2868): mutation info source: CCLE: ref target(-10 +10):
CACGTGGCCTGCAGTCCTACTATGCCGTGGCCCATGCTGTCAC (SEQ ID NO: 2869): mut target(-
10 +10): CACGTGGCCT-----------------------ATGCTGTCAC (SEQ ID NO: 2870): [Model Cell line
information]: cell: A549: cancer type: LUNG: PAM dist: 19: indel length: 23: CRISPR gRNA ID: GF-
CCELg9-832: [crRNA sequence]: crRNA sequence: ACAGCATAGGCCACGTGCAAGGG (SEQ ID NO:
2877):
SpgRNA: attctaatacgactcactataggACAGCATAGGCCACGTGCAAgttttagagctagaaatagcaagttaaaataaggctagtccgt
tatcaacttgaaaaagtggcaccgagtcggtgc (SEQ ID NO: 2878): [Target gene information]: Gene ID: 6597: Symbol:
SMARCA4: Ensembl Transcript ID: ENST00000429416.3: GRCh: 37: Chr: 19: [Target cancer mutation
information]: mut start: 11121117: mut end: 11121139: mut class: Frame Shift Del: mut type: DEL: ref seq:
GCAGTCCTACTATGCCGTGGCCC (SEQ ID NO: 2867): mut seq: -: mut aa: p.QSYYAVAH729fs
("QSYYAVAH" disclosed as SEQ ID NO: 2868): mutation info source: CCLE: ref target(-10 +10):
CACGTGGCCTGCAGTCCTACTATGCCGTGGCCCATGCTGTCAC (SEQ ID NO: 2869): mut target(-
10 +10): CACGTGGCCT-----------------------ATGCTGTCAC (SEQ ID NO: 2870): [Model Cell line
information]: cell: A549: cancer type: LUNG: PAM dist: 14: indel length: 23: CRISPR gRNA ID: GF-
CCELg9-833: [crRNA sequence]: crRNA sequence: TAGGCCACGTGCAAGGGCCTGGG (SEQ ID NO:
2879):
SpgRNA: attctaatacgactcactataggTAGGCCACGTGCAAGGGCCTgttttagagctagaaatagcaagttaaaataaggctagtccgtt
atcaacttgaaaaagtggcaccgagtcggtgc (SEQ ID NO: 2880): [Target gene information]: Gene ID: 6597: Symbol:
SMARCA4: Ensembl Transcript ID: EN5T00000429416.3: GRCh: 37: Chr: 19: [Target cancer mutation
information]: mut start: 11121117: mut end: 11121139: mut class: Frame Shift Del: mut type: DEL: ref seq:
GCAGTCCTACTATGCCGTGGCCC (SEQ ID NO: 2867): mut seq: -: mut aa: p.QSYYAVAH729fs
("QSYYAVAH" disclosed as SEQ ID NO: 2868): mutation info source: CCLE: ref target(-10 +10):
CACGTGGCCTGCAGTCCTACTATGCCGTGGCCCATGCTGTCAC (SEQ ID NO: 2869): mut target(-10 +10):
10 +10): CACGTGGCCT-----------------------ATGCTGTCAC (SEQ ID NO: 2870): [Model Cell line
information]: cell: A549: cancer type: LUNG: PAM dist: 20: indel length: 23: CRISPR gRNA ID: GF-
CCELg9-834: [crRNA sequence]: crRNA sequence: TTCCTGCTCAGCACCCGGGCTGG (SEQ ID NO:
2881):
SpgRNA: attctaatacgactcactataggTTCCTGCTCAGCACCCGGGCgttttagagctagaaatagcaagttaaaataaggctagtccgtt
atcaacttgaaaaagtggcaccgagtcggtgc (SEQ ID NO: 2882): [Target gene information]: Gene ID: 6597: Symbol:
SMARCA4: Ensembl Transcript ID: EN5T00000429416.3: GRCh: 37: Chr: 19: [Target cancer mutation
information]: mut start: 11141498: mut end: 11141498: mut class: Frame Shift Del: mut type: DEL: ref seq:
G: mut seq: -: mut aa: p.G1160fs: mutation info source: CCLE: ref target(-10 +10):
CACCCGGGCTGGGGGGCTCGG (SEQ ID NO: 2883): mut target(-10 +10): CACCCGGGCT- TABLE 7-continued Illustrative guide RNA sequences for polypeptides comprising Cas9

GGGGGCTCGG (SEQ ID NO: 2884): [Model Cell line information]: cell: NCIH661: cancer type: LUNG: PAM dist: 0: indel length: 1: CRISPR gRNA ID: GF-CCELg9-835: [crRNA sequence]: crRNA sequence: CAGCACCCGGGCTGGGGGCTCGG (SEQ ID NO: 2885):
SpgRNA: attctaatacgactcactataggCAGCACCCGGGCTGGGGGCTgttttagagctagaaatagcaagttaaaataaggctagtccgttatcaacttgaaaaagtggcaccgagtcggtgc (SEQ ID NO: 2886): [Target gene information]: Gene ID: 6597: Symbol: SMARCA4: Ensembl Transcript ID: EN5T00000429416.3: GRCh: 37: Chr: 19: [Target cancer mutation information]: mut start: 11141498: mut end: 11141498: mut class: Frame Shift Del: mut type: DEL: ref seq: G: mut seq: -: mut aa: p.G1160fs: mutation info source: CCLE: ref target(-10 +10): CACCCGGGCTGGGGGCTCGG (SEQ ID NO: 2883): mut target(-10 +10): CACCCGGGCT-GGGGGCTCGG (SEQ ID NO: 2884): [Model Cell line information]: cell: NCIH661: cancer type: LUNG: PAM dist: 8: indel length: 1: CRISPR gRNA ID: GF-CCELg9-836: [crRNA sequence]: crRNA sequence: TCCTGCTCAGCACCCGGGCTGGG (SEQ ID NO: 2887):
SpgRNA: attctaatacgactcactataggTCCTGCTCAGCACCCGGGCTgttttagagctagaaatagcaagttaaaataaggctagtccgttatcaacttgaaaaagtggcaccgagtcggtgc (SEQ ID NO: 2888): [Target gene information]: Gene ID: 6597: Symbol: SMARCA4: Ensembl Transcript ID: EN5T00000429416.3: GRCh: 37: Chr: 19: [Target cancer mutation information]: mut start: 11141498: mut end: 11141498: mut class: Frame Shift Del: mut type: DEL: ref seq: G: mut seq: -: mut aa: p.G1160fs: mutation info source: CCLE: ref target(-10 +10): CACCCGGGCTGGGGGCTCGG (SEQ ID NO: 2883): mut target(-10 +10): CACCCGGGCT-GGGGGCTCGG (SEQ ID NO: 2884): [Model Cell line information]: cell: NCIH661: cancer type: LUNG: PAM dist: 1: indel length: 1: CRISPR gRNA ID: GF-CCELg9-837: [crRNA sequence]: crRNA sequence: CCTGCTCAGCACCCGGGCTGGGG (SEQ ID NO: 2889):
SpgRNA: attctaatacgactcactataggCCTGCTCAGCACCCGGGCTGgttttagagctagaaatagcaagttaaaataaggctagtccgttatcaacttgaaaaagtggcaccgagtcggtgc (SEQ ID NO: 2890): [Target gene information]: Gene ID: 6597: Symbol: SMARCA4: Ensembl Transcript ID: EN5T00000429416.3: GRCh: 37: Chr: 19: [Target cancer mutation information]: mut start: 11141498: mut end: 11141498: mut class: Frame Shift Del: mut type: DEL: ref seq: G: mut seq: -: mut aa: p.G1160fs: mutation info source: CCLE: ref target(-10 +10): CACCCGGGCTGGGGGCTCGG (SEQ ID NO: 2883): mut target(-10 +10): CACCCGGGCT-GGGGGCTCGG (SEQ ID NO: 2884): [Model Cell line information]: cell: NCIH661: cancer type: LUNG: PAM dist: 2: indel length: 1: CRISPR gRNA ID: GF-CCELg9-838: [crRNA sequence]: crRNA sequence: CTGCTCAGCACCCGGGCTGGGGG (SEQ ID NO: 2891):
SpgRNA: attctaatacgactcactataggCTGCTCAGCACCCGGGCTGGgttttagagctagaaatagcaagttaaaataaggctagtccgttatcaacttgaaaaagtggcaccgagtcggtgc (SEQ ID NO: 2892): [Target gene information]: Gene ID: 6597: Symbol: SMARCA4: Ensembl Transcript ID: EN5T00000429416.3: GRCh: 37: Chr: 19: [Target cancer mutation information]: mut start: 11141498: mut end: 11141498: mut class: Frame Shift Del: mut type: DEL: ref seq: G: mut seq: -: mut aa: p.G1160fs: mutation info source: CCLE: ref target(-10 +10): CACCCGGGCTGGGGGCTCGG (SEQ ID NO: 2883): mut target(-10 +10): CACCCGGGCT-GGGGGCTCGG (SEQ ID NO: 2884): [Model Cell line information]: cell: NCIH661: cancer type: LUNG: PAM dist: 3: indel length: 1: CRISPR gRNA ID: GF-CCELg9-839: [crRNA sequence]: crRNA sequence: CCCCCAGCCCGGGTGCTGAGCAGG (SEQ ID NO: 2893):
SpgRNA: attctaatacgactcactataggCCCCAGCCCGGGTGCTGAGCgttttagagctagaaatagcaagttaaaataaggctagtccgttatcaacttgaaaaagtggcaccgagtcggtgc (SEQ ID NO: 2894): [Target gene information]: Gene ID: 6597: Symbol: SMARCA4: Ensembl Transcript ID: EN5T00000429416.3: GRCh: 37: Chr: 19: [Target cancer mutation information]: mut start: 11141498: mut end: 11141498: mut class: Frame Shift Del: mut type: DEL: ref seq: G: mut seq: -: mut aa: p.G1160fs: mutation info source: CCLE: ref target(-10 +10): CACCCGGGCTGGGGGCTCGG (SEQ ID NO: 2883): mut target(-10 +10): CACCCGGGCT-GGGGGCTCGG (SEQ ID NO: 2884): [Model Cell line information]: cell: NCIH661: cancer type: LUNG: PAM dist: 17: indel length: 1: CRISPR gRNA ID: GF-CCELg9-840: [crRNA sequence]: crRNA sequence: TTCAGGCCGAGCCCCCAGCCCGG (SEQ ID NO: 2895):
SpgRNA: attctaatacgactcactataggTTCAGGCCGAGCCCCCAGCCgttttagagctagaaatagcaagttaaaataaggctagtccgttatcaacttgaaaaagtggcaccgagtcggtgc (SEQ ID NO: 2896): [Target gene information]: Gene ID: 6597: Symbol: SMARCA4: Ensembl Transcript ID: EN5T00000429416.3: GRCh: 37: Chr: 19: [Target cancer mutation information]: mut start: 11141498: mut end: 11141498: mut class: Frame Shift Del: mut type: DEL: ref seq: G: mut seq: -: mut aa: p.G1160fs: mutation info source: CCLE: ref target(-10 +10): CACCCGGGCTGGGGGCTCGG (SEQ ID NO: 2883): mut target(-10 +10): CACCCGGGCT-GGGGGCTCGG (SEQ ID NO: 2884): [Model Cell line information]: cell: NCIH661: cancer type: LUNG: PAM dist: 5: indel length: 1: CRISPR gRNA ID: GF-CCELg9-841: [crRNA sequence]: crRNA sequence: TCAGGCCGAGCCCCCAGCCCGGG (SEQ ID NO: 2897):
SpgRNA: attctaatacgactcactataggTCAGGCCGAGCCCCCAGCCCgttttagagctagaaatagcaagttaaaataaggctagtccgttatcaacttgaaaaagtggcaccgagtcggtgc (SEQ ID NO: 2898): [Target gene information]: Gene ID: 6597: Symbol: SMARCA4: Ensembl Transcript ID: EN5T00000429416.3: GRCh: 37: Chr: 19: [Target cancer mutation information]: mut start: 11141498: mut end: 11141498: mut class: Frame Shift Del: mut type: DEL: ref seq: G: mut seq: -: mut aa: p.G1160fs: mutation info source: CCLE: ref target(-10 +10): CACCCGGGCTGGGGGCTCGG (SEQ ID NO: 2883): mut target(-10 +10): CACCCGGGCT-GGGGGCTCGG (SEQ ID NO: 2884): [Model Cell line information]: cell: NCIH661: cancer type: LUNG: PAM dist: 6: indel length: 1: CRISPR gRNA ID: GF-CCELg9-842: [crRNA sequence]: crRNA sequence: TGTCAGGCCAATGTGACCATAGG (SEQ ID NO: 2899):
SpgRNA: attctaatacgactcactataggTGTCAGGCCAATGTGACCATgttttagagctagaaatagcaagttaaaataaggctagtccgttatcaacttgaaaaagtggcaccgagtcggtgc (SEQ ID NO: 2900): [Target gene information]: Gene ID: 6608: Symbol: SMO: Ensembl Transcript ID: EN5T00000249373.3: GRCh: 37: Chr: 7: [Target cancer mutation information]: mut start: 128850225: mut end: 128850225: mut class: Silent: mut type: SNP: ref seq: C: mut seq: A: mut aa: p.I4961: mutation info source: CCLE: ref target(-10 +10): ATGTGACCATCGGGCTGCCCA (SEQ ID NO: 2901): mut target(-10 +10): ATGTGACCATAGGGCTGCCCA (SEQ ID NO: 2902):
[Model Cell line information]: cell: A549: cancer type: LUNG: PAM dist: 0: indel length: 0: CRISPR gRNA ID: GF-CCELg9-843: [crRNA sequence]: crRNA sequence: GTCAGGCCAATGTGACCATAGGG (SEQ ID NO: 2903):
SpgRNA: attctaatacgactcactataggGTCAGGCCAATGTGACCATAgttttagagctagaaatagcaagttaaaataaggctagtccgttatcaacttgaaaaagtggcaccgagtcggtgc (SEQ ID NO: 2904): [Target gene information]: Gene ID: 6608: Symbol: SMO: Ensembl Transcript ID: EN5T00000249373.3: GRCh: 37: Chr: 7: [Target cancer mutation TABLE 7-continued Illustrative guide RNA sequences for polypeptides comprising Cas9 information]: mut start: 128850225: mut end: 128850225: mut class: Silent: mut type: SNP: ref seq: C: mut
seq: A: mut aa: p.I496I: mutation info source: CCLE: ref target(-10 +10): ATGTGACCATCGGGCTGCCCA
(SEQ ID NO: 2901): mut target(-10 +10): ATGTGACCATAGGGCTGCCCA (SEQ ID NO: 2902):
[Model Cell line information]: cell: A549: cancer type: LUNG: PAM dist: 1: indel length: 0: CRISPR gRNA
ID: GF-CCELg9-844: [crRNA sequence]: crRNA sequence: CTGCTTGGTGGGCAGCCCTATGG (SEQ ID
NO: 2905):
SpgRNA: attctaatacgactcactataggCTGCTTGGTGGGCAGCCCTAg agagctagaaatagcaagttaaaataaggctagtccgtt
atcaacttgaaaaagtggcaccgagtcggtgc (SEQ ID NO: 2906): [Target gene information]: Gene ID: 6608: Symbol:
SMO: Ensembl Transcript ID: EN5T00000249373.3: GRCh: 37: Chr: 7: [Target cancer mutation
information]: mut start: 128850225: mut end: 128850225: mut class: Silent: mut type: SNP: ref seq: C: mut
seq: A: mut aa: p.I496I: mutation info source: CCLE: ref target(-10 +10): ATGTGACCATCGGGCTGCCCA
(SEQ ID NO: 2901): mut target(-10 +10): ATGTGACCATAGGGCTGCCCA (SEQ ID NO: 2902):
[Model Cell line information]: cell: A549: cancer type: LUNG: PAM dist: 2: indel length: 0: CRISPR gRNA
ID: GF-CCELg9-845: [crRNA sequence]: crRNA sequence: GGGCAGCCCTATGGTCACATTGG (SEQ ID
NO: 2907):
SpgRNA: attctaatacgactcactataggGGGCAGCCCTATGGTCACATGttttagagctagaaatagcaagttaaaataaggctagtccgtt
atcaacttgaaaaagtggcaccgagtcggtgc (SEQ ID NO: 2908): [Target gene information]: Gene ID: 6608: Symbol:
SMO: Ensembl Transcript ID: EN5T00000249373.3: GRCh: 37: Chr: 7: [Target cancer mutation
information]: mut start: 128850225: mut end: 128850225: mut class: Silent: mut type: SNP: ref seq: C: mut
seq: A: mut aa: p.I496I: mutation info source: CCLE: ref target(-10 +10): ATGTGACCATCGGGCTGCCCA
(SEQ ID NO: 2901): mut target(-10 +10): ATGTGACCATAGGGCTGCCCA (SEQ ID NO: 2902):
[Model Cell line information]: cell: A549: cancer type: LUNG: PAM dist: 11: indel length: 0: CRISPR
gRNA ID: GF-CCELg9-846: [crRNA sequence]: crRNA sequence: GCCCAGTGCACCGGCCCCAGTGG
(SEQ ID NO: 2909):
SpgRNA: attctaatacgactcactataggGCCCAGTGCACCGGCCCCAGg agagctagaaatagcaagttaaaataaggctagtccgtt
atcaacttgaaaaagtggcaccgagtcggtgc (SEQ ID NO: 2910): [Target gene information]: Gene ID: 6608: Symbol:
SMO: Ensembl Transcript ID: EN5T00000249373.3: GRCh: 37: Chr: 7: [Target cancer mutation
information]: mut start: 128852193: mut end: 128852193: mut class: Silent: mut type: SNP: ref seq: C: mut
seq: A: mut aa: p.P755P: mutation info source: CCLE: ref target(-10 +10):
CACCGGCCCCCGTGGCATGGG (SEQ ID NO: 905): mut target(-10 +10):
CACCGGCCCCAGTGGCATGGG (SEQ ID NO: 906): [Model Cell line information]: cell: NCIH2126:
cancer type: LUNG: PAM dist: 2: indel length: 0: CRISPR gRNA ID: GF-CCELg9-847: [crRNA sequence]:
crRNA sequence: GTGCACCGGCCCCAGTGGCATGG (SEQ ID NO: 2911):
SpgRNA: attctaatacgactcactataggGTGCACCGGCCCCAGTGGCATGg ttttagagctagaaatagcaagttaaaataaggctagtccgtt
atcaacttgaaaaagtggcaccgagtcggtgc (SEQ ID NO: 2912): [Target gene information]: Gene ID: 6608: Symbol:
SMO: Ensembl Transcript ID: EN5T00000249373.3: GRCh: 37: Chr: 7: [Target cancer mutation
information]: mut start: 128852193: mut end: 128852193: mut class: Silent: mut type: SNP: ref seq: C: mut
seq: A: mut aa: p.P755P: mutation info source: CCLE: ref target(-10 +10):
CACCGGCCCCCGTGGCATGGG (SEQ ID NO: 905): mut target(-10 +10):
CACCGGCCCCAGTGGCATGGG (SEQ ID NO: 906): [Model Cell line information]: cell: NCIH2126:
cancer type: LUNG: PAM dist: 7: indel length: 0: CRISPR gRNA ID: GF-CCELg9-848: [crRNA sequence]:
crRNA sequence: GCCCCAGTGGCATGGGCTCATGG (SEQ ID NO: 2913):
SpgRNA: attctaatacgactcactataggGCCCCAGTGGCATGGGCTCAg ttttagagctagaaatagcaagttaaaataaggctagtccgtt
atcaacttgaaaaagtggcaccgagtcggtgc (SEQ ID NO: 2914): [Target gene information]: Gene ID: 6608: Symbol:
SMO: Ensembl Transcript ID: EN5T00000249373.3: GRCh: 37: Chr: 7: [Target cancer mutation
information]: mut start: 128852193: mut end: 128852193: mut class: Silent: mut type: SNP: ref seq: C: mut
seq: A: mut aa: p.P755P: mutation info source: CCLE: ref target(-10 +10):
CACCGGCCCCCGTGGCATGGG (SEQ ID NO: 905): mut target(-10 +10):
CACCGGCCCCAGTGGCATGGG (SEQ ID NO: 906): [Model Cell line information]: cell: NCIH2126:
cancer type: LUNG: PAM dist: 15: indel length: 0: CRISPR gRNA ID: GF-CCELg9-849: [crRNA sequence]:
crRNA sequence: TGCACCGGCCCCAGTGGCATGGG (SEQ ID NO: 2915):
SpgRNA: attctaatacgactcactataggTGCACCGGCCCCAGTGGCATg ttttagagctagaaatagcaagttaaaataaggctagtccgtt
atcaacttgaaaaagtggcaccgagtcggtgc (SEQ ID NO: 2916): [Target gene information]: Gene ID: 6608: Symbol:
SMO: Ensembl Transcript ID: EN5T00000249373.3: GRCh: 37: Chr: 7: [Target cancer mutation
information]: mut start: 128852193: mut end: 128852193: mut class: Silent: mut type: SNP: ref seq: C: mut
seq: A: mut aa: p.P755P: mutation info source: CCLE: ref target(-10 +10):
CACCGGCCCCCGTGGCATGGG (SEQ ID NO: 905): mut target(-10 +10):
CACCGGCCCCAGTGGCATGGG (SEQ ID NO: 906): [Model Cell line information]: cell: NCIH2126:
cancer type: LUNG: PAM dist: 8: indel length: 0: CRISPR gRNA ID: GF-CCELg9-850: [crRNA sequence]:
crRNA sequence: CGGCCATGAGCCCATGCCACTGG (SEQ ID NO: 2917):
SpgRNA: attctaatacgactcactataggCGGCCATGAGCCCATGCCACg ttttagagctagaaatagcaagttaaaataaggctagtccgtt
atcaacttgaaaaagtggcaccgagtcggtgc (SEQ ID NO: 2918): [Target gene information]: Gene ID: 6608: Symbol:
SMO: Ensembl Transcript ID: EN5T00000249373.3: GRCh: 37: Chr: 7: [Target cancer mutation
information]: mut start: 128852193: mut end: 128852193: mut class: Silent: mut type: SNP: ref seq: C: mut
seq: A: mut aa: p.P755P: mutation info source: CCLE: ref target(-10 +10):
CACCGGCCCCCGTGGCATGGG (SEQ ID NO: 905): mut target(-10 +10):
CACCGGCCCCAGTGGCATGGG (SEQ ID NO: 906): [Model Cell line information]: cell: NCIH2126:
cancer type: LUNG: PAM dist: 0: indel length: 0: CRISPR gRNA ID: GF-CCELg9-851: [crRNA sequence]:
crRNA sequence: TGCCACTGGGGCCGGTGCACTGG (SEQ ID NO: 2919):
SpgRNA: attctaatacgactcactataggTGCCACTGGGGCCGGTGCACgttttagagctagaaatagcaagttaaaataaggctagtccgtt
atcaacttgaaaaagtggcaccgagtcggtgc (SEQ ID NO: 2920): [Target gene information]: Gene ID: 6608: Symbol:
SMO: Ensembl Transcript ID: EN5T00000249373.3: GRCh: 37: Chr: 7: [Target cancer mutation
information]: mut start: 128852193: mut end: 128852193: mut class: Silent: mut type: SNP: ref seq: C: mut
seq: A: mut aa: p.P755P: mutation info source: CCLE: ref target(-10 +10):
CACCGGCCCCCGTGGCATGGG (SEQ ID NO: 905): mut target(-10 +10):
CACCGGCCCCAGTGGCATGGG (SEQ ID NO: 906): [Model Cell line information]: cell: NCIH2126:
cancer type: LUNG: PAM dist: 14: indel length: 0: CRISPR gRNA ID: GF-CCELg9-852: [crRNA sequence]:
crRNA sequence: TGAGCCCATGCCACTGGGGCCGG (SEQ ID NO: 2921):

TABLE 7-continued

Illustrative guide RNA sequences for polypeptides comprising Cas9

SpgRNA: attctaatacgactcactataggTGAGCCCATGCCACTGGGGCgttttagagctagaaatagcaagttaaaataaggctagtccgtt
atcaacttgaaaaagtggcaccgagtcggtgc (SEQ ID NO: 2922): [Target gene information]: Gene ID: 6608: Symbol:
SMO: Ensembl Transcript ID: EN5T00000249373.3: GRCh: 37: Chr: 7: [Target cancer mutation
information]: mut start: 128852193: mut end: 128852193: mut class: Silent: mut type: SNP: ref seq: C: mut
seq: A: mut aa: p.P755P: mutation info source: CCLE: ref target(-10 +10):
CACCGGCCCCCGTGGCATGGG (SEQ ID NO: 905): mut target(-10 +10):
CACCGGCCCCAGTGGCATGGG (SEQ ID NO: 906): [Model Cell line information]: cell: NCIH2126:
cancer type: LUNG: PAM dist: 6: indel length: 0: CRISPR gRNA ID: GF-CCELg9-853: [crRNA sequence]:
crRNA sequence: GGCCATGAGCCCATGCCACTGGG (SEQ ID NO: 2923):
SpgRNA: attctaatacgactcactataggGGCCATGAGCCCATGCCACTgttttagagctagaaatagcaagttaaaataaggctagtccgtt
atcaacttgaaaaagtggcaccgagtcggtgc (SEQ ID NO: 2924): [Target gene information]: Gene ID: 6608: Symbol:
SMO: Ensembl Transcript ID: EN5T00000249373.3: GRCh: 37: Chr: 7: [Target cancer mutation
information]: mut start: 128852193: mut end: 128852193: mut class: Silent: mut type: SNP: ref seq: C: mut
seq: A: mut aa: p.P755P: mutation info source: CCLE: ref target(-10 +10):
CACCGGCCCCCGTGGCATGGG (SEQ ID NO: 905): mut target(-10 +10):
CACCGGCCCCAGTGGCATGGG (SEQ ID NO: 906): [Model Cell line information]: cell: NCIH2126:
cancer type: LUNG: PAM dist: 1: indel length: 0: CRISPR gRNA ID: GF-CCELg9-854: [crRNA sequence]:
crRNA sequence: GCCATGAGCCCATGCCACTGGGG (SEQ ID NO: 2925):
SpgRNA: attctaatacgactcactataggGCCATGAGCCCATGCCACTGgttttagagctagaaatagcaagttaaaataaggctagtccgtt
atcaacttgaaaaagtggcaccgagtcggtgc (SEQ ID NO: 292 6): [Target gene information]: Gene ID: 6608: Symbol:
SMO: Ensembl Transcript ID: EN5T00000249373.3: GRCh: 37: Chr: 7: [Target cancer mutation
information]: mut start: 128852193: mut end: 128852193: mut class: Silent: mut type: SNP: ref seq: C: mut
seq: A: mut aa: p.P755P: mutation info source: CCLE: ref target(-10 +10):
CACCGGCCCCCGTGGCATGGG (SEQ ID NO: 905): mut target(-10 +10):
CACCGGCCCCAGTGGCATGGG (SEQ ID NO: 906): [Model Cell line information]: cell: NCIH2126:
cancer type: LUNG: PAM dist: 2: indel length: 0: CRISPR gRNA ID: GF-CCELg9-855: [crRNA sequence]:
crRNA sequence: GCCACTGGGGCCGGTGCACTGGG (SEQ ID NO: 2927):
SpgRNA: attctaatacgactcactataggGCCACTGGGGCCGGTGCACTgttttagagctagaaatagcaagttaaaataaggctagtccgtt
atcaacttgaaaaagtggcaccgagtcggtgc (SEQ ID NO: 292 8): [Target gene information]: Gene ID: 6608: Symbol:
SMO: Ensembl Transcript ID: EN5T00000249373.3: GRCh: 37: Chr: 7: [Target cancer mutation
information]: mut start: 128852193: mut end: 128852193: mut class: Silent: mut type: SNP: ref seq: C: mut
seq: A: mut aa: p.P755P: mutation info source: CCLE: ref target(-10 +10):
CACCGGCCCCCGTGGCATGGG (SEQ ID NO: 905): mut target(-10 +10):
CACCGGCCCCAGTGGCATGGG (SEQ ID NO: 906): [Model Cell line information]: cell: NCIH2126:
cancer type: LUNG: PAM dist: 15: indel length: 0: CRISPR gRNA ID: GF-CCELg9-856: [crRNA sequence]:
crRNA sequence: AGACCCACAGCCCCCAGCATTGG (SEQ ID NO: 2929):
SpgRNA: attctaatacgactcactataggAGACCCACAGCCCCCAGCATgttttagagctagaaatagcaagttaaaataaggctagtccgtt
atcaacttgaaaaagtggcaccgagtcggtgc (SEQ ID NO: 293 0): [Target gene information]: Gene ID: 6662: Symbol:
5OX9: Ensembl Transcript ID: EN5T00000245479.2: GRCh: 37: Chr: 17: [Target cancer mutation
information]: mut start: 70120489: mut end: 70120489: mut class: Silent: mut type: SNP: ref seq: C: mut
seq: T: mut aa: p.H497H: mutation info source: CCLE: ref target(-10 +10):
GCCCCCAGCACTGGGAACAAC (SEQ ID NO: 2931): mut target(-10 +10):
GCCCCCAGCATTGGGAACAAC (SEQ ID NO: 2932): [Model Cell line information]: cell: NCIH661:
cancer type: LUNG: PAM dist: 1: indel length: 0: CRISPR gRNA ID: GF-CCELg9-857: [crRNA sequence]:
crRNA sequence: GACCCACAGCCCCCAGCATTGGG (SEQ ID NO: 2933):
SpgRNA: attctaatacgactcactataggGACCCACAGCCCCCAGCATTgttttagagctagaaatagcaagttaaaataaggctagtccgtt
atcaacttgaaaaagtggcaccgagtcggtgc (SEQ ID NO: 293 4): [Target gene information]: Gene ID: 6662: Symbol:
5OX9: Ensembl Transcript ID: EN5T00000245479.2: GRCh: 37: Chr: 17: [Target cancer mutation
information]: mut start: 70120489: mut end: 70120489: mut class: Silent: mut type: SNP: ref seq: C: mut
seq: T: mut aa: p.H497H: mutation info source: CCLE: ref target(-10 +10):
GCCCCCAGCACTGGGAACAAC (SEQ ID NO: 2931): mut target(-10 +10):
GCCCCCAGCATTGGGAACAAC (SEQ ID NO: 2932): [Model Cell line information]: cell: NCIH661:
cancer type: LUNG: PAM dist: 2: indel length: 0: CRISPR gRNA ID: GF-CCELg9-858: [crRNA sequence]:
crRNA sequence: AGACGGGTTGTTCCCAATGCTGG (SEQ ID NO: 2935):
SpgRNA: attctaatacgactcactataggAGACGGGTTGTTCCCAATGCgttttagagctagaaatagcaagttaaaataaggctagtccgtt
atcaacttgaaaaagtggcaccgagtcggtgc (SEQ ID NO: 293 6): [Target gene information]: Gene ID: 6662: Symbol:
5OX9: Ensembl Transcript ID: EN5T00000245479.2: GRCh: 37: Chr: 17: [Target cancer mutation
information]: mut start: 70120489: mut end: 70120489: mut class: Silent: mut type: SNP: ref seq: C: mut
seq: T: mut aa: p.H497H: mutation info source: CCLE: ref target(-10 +10):
GCCCCCAGCACTGGGAACAAC (SEQ ID NO: 2931): mut target(-10 +10):
GCCCCCAGCATTGGGAACAAC (SEQ ID NO: 2932): [Model Cell line information]: cell: NCIH661:
cancer type: LUNG: PAM dist: 4: indel length: 0: CRISPR gRNA ID: GF-CCELg9-859: [crRNA sequence]:
crRNA sequence: GTTCCCAATGCTGGGGCTGTGG (SEQ ID NO: 2937):
SpgRNA: attctaatacgactcactataggGTTCCCAATGCTGGGGCTGgttttagagctagaaatagcaagttaaaataaggctagtccgtt
atcaacttgaaaaagtggcaccgagtcggtgc (SEQ ID NO: 293 8): [Target gene information]: Gene ID: 6662: Symbol:
5OX9: Ensembl Transcript ID: EN5T00000245479.2: GRCh: 37: Chr: 17: [Target cancer mutation
information]: mut start: 70120489: mut end: 70120489: mut class: Silent: mut type: SNP: ref seq: C: mut
seq: T: mut aa: p.H497H: mutation info source: CCLE: ref target(-10 +10):
GCCCCCAGCACTGGGAACAAC (SEQ ID NO: 2931): mut target(-10 +10):
GCCCCCAGCATTGGGAACAAC (SEQ ID NO: 2932): [Model Cell line information]: cell: NCIH661:
cancer type: LUNG: PAM dist: 13: indel length: 0: CRISPR gRNA ID: GF-CCELg9-860: [crRNA sequence]:
crRNA sequence: GACGGGTTGTTCCCAATGCTGGG (SEQ ID NO: 2939):
SpgRNA: attctaatacgactcactataggGACGGGTTGTTCCCAATGCTgttttagagctagaaatagcaagttaaaataaggctagtccgtt
atcaacttgaaaaagtggcaccgagtcggtgc (SEQ ID NO: 2940): [Target gene information]: Gene ID: 6662: Symbol:
5OX9: Ensembl Transcript ID: EN5T00000245479.2: GRCh: 37: Chr: 17: [Target cancer mutation
information]: mut start: 70120489: mut end: 70120489: mut class: Silent: mut type: SNP: ref seq: C: mut
seq: T: mut aa: p.H497H: mutation info source: CCLE: ref target(-10 +10):
GCCCCCAGCACTGGGAACAAC (SEQ ID NO: 2931): mut target(-10 +10):

TABLE 7-continued

Illustrative guide RNA sequences for polypeptides comprising Cas9

GCCCCCAGCATTGGGAACAAC (SEQ ID NO: 2932): [Model Cell line information]: cell: NCIH661:
cancer type: LUNG: PAM dist: 5: indel length: 0: CRISPR gRNA ID: GF-CCELg9-861: [crRNA sequence]:
crRNA sequence: ACGGGTTGTTCCCAATGCTGGGG (SEQ ID NO: 2941):
SpgRNA: attctaatacgactcactataggACGGGTTGTTCCCAATGCTGGgttttagagctagaaatagcaagttaaaataaggctagtccgtt atcaacttgaaaaagtggcaccgagtcggtgc (SEQ ID NO: 2942): [Target gene information]: Gene ID: 6662: Symbol:
SOX9: Ensembl Transcript ID: EN5T00000245479.2: GRCh: 37: Chr: 17: [Target cancer mutation
information]: mut start: 70120489: mut end: 70120489: mut class: Silent: mut type: SNP: ref seq: C: mut
seq: T: mut aa: p.H497H: mutation info source: CCLE: ref target(-10 +10):
GCCCCCAGCACTGGGAACAAC (SEQ ID NO: 2931): mut target(-10 +10):
GCCCCCAGCATTGGGAACAAC (SEQ ID NO: 2932): [Model Cell line information]: cell: NCIH661:
cancer type: LUNG: PAM dist: 6: indel length: 0: CRISPR gRNA ID: GF-CCELg9-862: [crRNA sequence]:
crRNA sequence: CGGGTTGTTCCCAATGCTGGGGG (SEQ ID NO: 2943):
SpgRNA: attctaatacgactcactataggCGGGTTGTTCCCAATGCTGGgttttagagctagaaatagcaagttaaaataaggctagtccgtt
atcaacttgaaaaagtggcaccgagtcggtgc (SEQ ID NO: 2944): [Target gene information]: Gene ID: 6662: Symbol:
SOX9: Ensembl Transcript ID: EN5T00000245479.2: GRCh: 37: Chr: 17: [Target cancer mutation
information]: mut start: 70120489: mut end: 70120489: mut class: Silent: mut type: SNP: ref seq: C: mut
seq: T: mut aa: p.H497H: mutation info source: CCLE: ref target(-10 +10):
GCCCCCAGCACTGGGAACAAC (SEQ ID NO: 2931): mut target(-10 +10):
GCCCCCAGCATTGGGAACAAC (SEQ ID NO: 2932): [Model Cell line information]: cell: NCIH661:
cancer type: LUNG: PAM dist: 7: indel length: 0: CRISPR gRNA ID: GF-CCELg9-863: [crRNA sequence]:
crRNA sequence: TTCCCAATGCTGGGGCTGTGGG (SEQ ID NO: 2945):
SpgRNA: attctaatacgactcactataggTTCCCAATGCTGGGGCTGTGGGgttttagagctagaaatagcaagttaaaataaggctagtccgtt
atcaacttgaaaaagtggcaccgagtcggtgc (SEQ ID NO: 2946): [Target gene information]: Gene ID: 6662: Symbol:
SOX9: Ensembl Transcript ID: EN5T00000245479.2: GRCh: 37: Chr: 17: [Target cancer mutation
information]: mut start: 70120489: mut end: 70120489: mut class: Silent: mut type: SNP: ref seq: C: mut
seq: T: mut aa: p.H497H: mutation info source: CCLE: ref target(-10 +10):
GCCCCCAGCACTGGGAACAAC (SEQ ID NO: 2931): mut target(-10 +10):
GCCCCCAGCATTGGGAACAAC (SEQ ID NO: 2932): [Model Cell line information]: cell: NCIH661:
cancer type: LUNG: PAM dist: 14: indel length: 0: CRISPR gRNA ID: GF-CCELg9-864: [crRNA sequence]:
crRNA sequence: GTCCTCCTCCGGCATGAGCGAGG (SEQ ID NO: 2947):
SpgRNA: attctaatacgactcactataggGTCCTCCTCCGGCATGAGCGgttttagagctagaaatagcaagttaaaataaggctagtccgtt
atcaacttgaaaaagtggcaccgagtcggtgc (SEQ ID NO: 2948): [Target gene information]: Gene ID: 6662: Symbol:
SOX9: Ensembl Transcript ID: EN5T00000245479.2: GRCh: 37: Chr: 17: [Target cancer mutation
information]: mut start: 70119067: mut end: 70119067: mut class: Missense Mutation: mut type: SNP: ref
seq: C: mut seq: G: mut aa: p.H213Q: mutation info source: CCLE: ref target(-10 +10):
ACTCGCCACACTCCTCCTCCG (SEQ ID NO: 2949): mut target(-10 +10):
ACTCGCCACAGTCCTCCTCCG (SEQ ID NO: 2950): [Model Cell line information]: cell: SW1990:
cancer type: PANCREAS: PAM dist: 20: indel length: 0: CRISPR gRNA ID: GF-CCELg9-865: [crRNA
sequence]: crRNA sequence: GACTCGCCACAGTCCTCCTCCGG (SEQ ID NO: 2951):
SpgRNA: attctaatacgactcactataggGACTCGCCACAGTCCTCCTCGgttttagagctagaaatagcaagttaaaataaggctagtccgtt
atcaacttgaaaaagtggcaccgagtcggtgc (SEQ ID NO: 2952): [Target gene information]: Gene ID: 6662: Symbol:
SOX9: Ensembl Transcript ID: EN5T00000245479.2: GRCh: 37: Chr: 17: [Target cancer mutation
information]: mut start: 70119067: mut end: 70119067: mut class: Missense Mutation: mut type: SNP: ref
seq: C: mut seq: G: mut aa: p.H213Q: mutation info source: CCLE: ref target(-10 +10):
ACTCGCCACACTCCTCCTCCG (SEQ ID NO: 2949): mut target(-10 +10):
ACTCGCCACAGTCCTCCTCCG (SEQ ID NO: 2950): [Model Cell line information]: cell: SW1990:
cancer type: PANCREAS: PAM dist: 9: indel length: 0: CRISPR gRNA ID: GF-CCELg9-866: [crRNA
sequence]: crRNA sequence: CTCATGCCGGAGGAGGACTGTGG (SEQ ID NO: 2953):
SpgRNA: attctaatacgactcactataggCTCATGCCGGAGGAGGACTGgttttagagctagaaatagcaagttaaaataaggctagtccgt
tatcaacttgaaaaagtggcaccgagtcggtgc (SEQ ID NO: 2954): [Target gene information]: Gene ID: 6662: Symbol:
SOX9: Ensembl Transcript ID: EN5T00000245479.2: GRCh: 37: Chr: 17: [Target cancer mutation
information]: mut start: 70119067: mut end: 70119067: mut class: Missense Mutation: mut type: SNP: ref
seq: C: mut seq: G: mut aa: p.H213Q: mutation info source: CCLE: ref target(-10 +10):
ACTCGCCACACTCCTCCTCCG (SEQ ID NO: 2949): mut target(-10 +10):
ACTCGCCACAGTCCTCCTCCG (SEQ ID NO: 2950): [Model Cell line information]: cell: SW1990:
cancer type: PANCREAS: PAM dist: 3: indel length: 0: CRISPR gRNA ID: GF-CCELg9-867: [crRNA
sequence]: crRNA sequence: GGAGGAGGACTGTGGCGAGTCG (SEQ ID NO: 2955):
SpgRNA: attctaatacgactcactataggGGAGGAGGACTGTGGCGAGTgttttagagctagaaatagcaagttaaaataaggctagtccgt
tatcaacttgaaaaagtggcaccgagtcggtgc (SEQ ID NO: 2956): [Target gene information]: Gene ID: 6662: Symbol:
SOX9: Ensembl Transcript ID: EN5T00000245479.2: GRCh: 37: Chr: 17: [Target cancer mutation
information]: mut start: 70119067: mut end: 70119067: mut class: Missense Mutation: mut type: SNP: ref
seq: C: mut seq: G: mut aa: p.H213Q: mutation info source: CCLE: ref target(-10 +10):
ACTCGCCACACTCCTCCTCCG (SEQ ID NO: 2949): mut target(-10 +10):
ACTCGCCACAGTCCTCCTCCG (SEQ ID NO: 2950): [Model Cell line information]: cell: SW1990:
cancer type: PANCREAS: PAM dist: 11: indel length: 0: CRISPR gRNA ID: GF-CCELg9-868: [crRNA
sequence]: crRNA sequence: GCACAATGCCTTTGCTGAGCCGG (SEQ ID NO: 2957):
SpgRNA: attctaatacgactcactataggGCACAATGCCTTTGCTGAGCgttttagagctagaaatagcaagttaaaataaggctagtccgtt
atcaacttgaaaaagtggcaccgagtcggtgc (SEQ ID NO: 2958): [Target gene information]: Gene ID: 6776: Symbol:
STAT5A: Ensembl Transcript ID: EN5T00000345506.4: GRCh: 37: Chr: 17: [Target cancer mutation
information]: mut start: 40457700: mut end: 40457700: mut class: Missense Mutation: mut type: SNP: ref
seq: G: mut seq: C: mut aa: p.D485H: mutation info source: CCLE: ref target(-10 +10):
TGTGCTGTGGGACAATGCCTTT (SEQ ID NO: 2959): mut target(-10 +10):
TGTGCTGTGGCACAATGCCTTT (SEQ ID NO: 2960): [Model Cell line information]: cell: NCIH1573:
cancer type: LUNG: PAM dist: 19: indel length: 0: CRISPR gRNA ID: GF-CCELg9-869: [crRNA sequence]:
crRNA sequence: GTGCCACAGCACAGTAGCCGTGG (SEQ ID NO: 2961):
SpgRNA: attctaatacgactcactataggGTGCCACAGCACAGTAGCCGgttttagagctagaaatagcaagttaaaataaggctagtccgt
tatcaacttgaaaaagtggcaccgagtcggtgc (SEQ ID NO: 2962): [Target gene information]: Gene ID: 6776: Symbol:

TABLE 7-continued

Illustrative guide RNA sequences for polypeptides comprising Cas9

STAT5A: Ensembl Transcript ID: ENST00000345506.4: GRCh: 37: Chr: 17: [Target cancer mutation
information]: mut start: 40457700: mut end: 40457700: mut class: Missense Mutation: mut type: SNP: ref
seq: G: mut seq: C: mut aa: p.D485H: mutation info source: CCLE: ref target(-10 +10):
TGTGCTGTGGGACAATGCCTT (SEQ ID NO: 2959): mut target(-10 +10):
TGTGCTGTGGCACAATGCCTT (SEQ ID NO: 2960): [Model Cell line information]: cell: NCIH1573:
cancer type: LUNG: PAM dist: 18: indel length: 0: CRISPR gRNA ID: GF-CCELg9-870: [crRNA sequence]:
crRNA sequence: TCTACTAGCCGCGCCGCAAGCGG (SEQ ID NO: 2963):
SpgRNA: attctaatacgactcactataggTCTACTAGCCGCGCCGCAAGGttttagagctagaaatagcaagttaaaataaggctagtccgtt
atcaacttgaaaaagtggcaccgagtcggtgc (SEQ ID NO: 2964): [Target gene information]: Gene ID: 6794: Symbol:
STK11: Ensembl Transcript ID: EN5T00000326873.7: GRCh: 37: Chr: 19: [Target cancer mutation
information]: mut start: 1207021: mut end: 1207021: mut class: Nonsense Mutation: mut type: SNP: ref seq:
C: mut seq: T: mut aa: p.Q37*: mutation info source: CCLE: ref target(-10 +10):
GGTCATCTACCAGCCGCGCCG (SEQ ID NO: 2965): mut target(-10 +10):
GGTCATCTACTAGCCGCGCCG (SEQ ID NO: 2966): [Model Cell line information]: cell: A549: cancer
type: LUNG: PAM dist: 15: indel length: 0: CRISPR gRNA ID: GF-CCELg9-871: [crRNA sequence]:
crRNA sequence: CTACTAGCCGCGCCGCAAGCGGG (SEQ ID NO: 2967):
SpgRNA: attctaatacgactcactataggCTACTAGCCGCGCCGCAAGCGttttagagctagaaatagcaagttaaaataaggctagtccgtt
atcaacttgaaaaagtggcaccgagtcggtgc (SEQ ID NO: 2968): [Target gene information]: Gene ID: 6794: Symbol:
STK11: Ensembl Transcript ID: EN5T00000326873.7: GRCh: 37: Chr: 19: [Target cancer mutation
information]: mut start: 1207021: mut end: 1207021: mut class: Nonsense Mutation: mut type: SNP: ref seq:
C: mut seq: T: mut aa: p.Q37*: mutation info source: CCLE: ref target(-10 +10):
GGTCATCTACCAGCCGCGCCG (SEQ ID NO: 2965): mut target(-10 +10):
GGTCATCTACTAGCCGCGCCG (SEQ ID NO: 2966): [Model Cell line information]: cell: A549: cancer
type: LUNG: PAM dist: 16: indel length: 0: CRISPR gRNA ID: GF-CCELg9-872: [crRNA sequence]:
crRNA sequence: CGGCTAGTAGATGACCTCGGTGG (SEQ ID NO: 2969):
SpgRNA: attctaatacgactcactataggCGGCTAGTAGATGACCTCGGttttagagctagaaatagcaagttaaaataaggctagtccgtt
atcaacttgaaaaagtggcaccgagtcggtgc (SEQ ID NO: 2970): [Target gene information]: Gene ID: 6794: Symbol:
STK11: Ensembl Transcript ID: EN5T00000326873.7: GRCh: 37: Chr: 19: [Target cancer mutation
information]: mut start: 1207021: mut end: 1207021: mut class: Nonsense Mutation: mut type: SNP: ref seq:
C: mut seq: T: mut aa: p.Q37*: mutation info source: CCLE: ref target(-10 +10):
GGTCATCTACCAGCCGCGCCG (SEQ ID NO: 2965): mut target(-10 +10):
GGTCATCTACTAGCCGCGCCG (SEQ ID NO: 2966): [Model Cell line information]: cell: A549: cancer
type: LUNG: PAM dist: 15: indel length: 0: CRISPR gRNA ID: GF-CCELg9-873: [crRNA sequence]:
crRNA sequence: GCGCGGCTAGTAGATGACCTCGG (SEQ ID NO: 2971):
SpgRNA: attctaatacgactcactataggGCGCGGCTAGTAGATGACCTGttttagagctagaaatagcaagttaaaataaggctagtccgtt
atcaacttgaaaaagtggcaccgagtcggtgc (SEQ ID NO: 2972): [Target gene information]: Gene ID: 6794: Symbol:
STK11: Ensembl Transcript ID: EN5T00000326873.7: GRCh: 37: Chr: 19: [Target cancer mutation
information]: mut start: 1207021: mut end: 1207021: mut class: Nonsense Mutation: mut type: SNP: ref seq:
C: mut seq: T: mut aa: p.Q37*: mutation info source: CCLE: ref target(-10 +10):
GGTCATCTACCAGCCGCGCCG (SEQ ID NO: 2965): mut target(-10 +10):
GGTCATCTACTAGCCGCGCCG (SEQ ID NO: 2966): [Model Cell line information]: cell: A549: cancer
type: LUNG: PAM dist: 12: indel length: 0: CRISPR gRNA ID: GF-CCELg9-874: [crRNA sequence]:
crRNA sequence: TCTACTAGCCGCGCCGCAAGCGG (SEQ ID NO: 2963):
SpgRNA: attctaatacgactcactataggTCTACTAGCCGCGCCGCAAGGttttagagctagaaatagcaagttaaaataaggctagtccgtt
atcaacttgaaaaagtggcaccgagtcggtgc (SEQ ID NO: 2964): [Target gene information]: Gene ID: 6794: Symbol:
STK11: Ensembl Transcript ID: EN5T00000326873.7: GRCh: 37: Chr: 19: [Target cancer mutation
information]: mut start: 1207021: mut end: 1207021: mut class: Nonsense Mutation: mut type: SNP: ref seq:
C: mut seq: T: mut aa: p.Q37*: mutation info source: CCLE: ref target(-10 +10):
GGTCATCTACCAGCCGCGCCG (SEQ ID NO: 2965): mut target(-10 +10):
GGTCATCTACTAGCCGCGCCG (SEQ ID NO: 2966): [Model Cell line information]: cell: NCIH460:
cancer type: LUNG: PAM dist: 15: indel length: 0: CRISPR gRNA ID: GF-CCELg9-875: [crRNA sequence]:
crRNA sequence: CTACTAGCCGCGCCGCAAGCGGG (SEQ ID NO: 2967):
SpgRNA: attctaatacgactcactataggCTACTAGCCGCGCCGCAAGCGttttagagctagaaatagcaagttaaaataaggctagtccgtt
atcaacttgaaaaagtggcaccgagtcggtgc (SEQ ID NO: 2968): [Target gene information]: Gene ID: 6794: Symbol:
STK11: Ensembl Transcript ID: EN5T00000326873.7: GRCh: 37: Chr: 19: [Target cancer mutation
information]: mut start: 1207021: mut end: 1207021: mut class: Nonsense Mutation: mut type: SNP: ref seq:
C: mut seq: T: mut aa: p.Q37*: mutation info source: CCLE: ref target(-10 +10):
GGTCATCTACCAGCCGCGCCG (SEQ ID NO: 2965): mut target(-10 +10):
GGTCATCTACTAGCCGCGCCG (SEQ ID NO: 2966): [Model Cell line information]: cell: NCIH460:
cancer type: LUNG: PAM dist: 16: indel length: 0: CRISPR gRNA ID: GF-CCELg9-876: [crRNA sequence]:
crRNA sequence: CGGCTAGTAGATGACCTCGGTGG (SEQ ID NO: 2969):
SpgRNA: attctaatacgactcactataggCGGCTAGTAGATGACCTCGGittttagagctagaaatagcaagttaaaataaggctagtccgtt
atcaacttgaaaaagtggcaccgagtcggtgc (SEQ ID NO: 2970): [Target gene information]: Gene ID: 6794: Symbol:
STK11: Ensembl Transcript ID: EN5T00000326873.7: GRCh: 37: Chr: 19: [Target cancer mutation
information]: mut start: 1207021: mut end: 1207021: mut class: Nonsense Mutation: mut type: SNP: ref seq:
C: mut seq: T: mut aa: p.Q37*: mutation info source: CCLE: ref target(-10 +10):
GGTCATCTACCAGCCGCGCCG (SEQ ID NO: 2965): mut target(-10 +10):
GGTCATCTACTAGCCGCGCCG (SEQ ID NO: 2966): [Model Cell line information]: cell: NCIH460:
cancer type: LUNG: PAM dist: 15: indel length: 0: CRISPR gRNA ID: GF-CCELg9-877: [crRNA sequence]:
crRNA sequence: GCGCGGCTAGTAGATGACCTCGG (SEQ ID NO: 2971):
SpgRNA: attctaatacgactcactataggGCGCGGCTAGTAGATGACCTGttttagagctagaaatagcaagttaaaataaggctagtccgtt
atcaacttgaaaaagtggcaccgagtcggtgc (SEQ ID NO: 2972): [Target gene information]: Gene ID: 6794: Symbol:
STK11: Ensembl Transcript ID: EN5T00000326873.7: GRCh: 37: Chr: 19: [Target cancer mutation
information]: mut start: 1207021: mut end: 1207021: mut class: Nonsense Mutation: mut type: SNP: ref seq:
C: mut seq: T: mut aa: p.Q37*: mutation info source: CCLE: ref target(-10 +10):
GGTCATCTACCAGCCGCGCCG (SEQ ID NO: 2965): mut target(-10 +10):

TABLE 7-continued

Illustrative guide RNA sequences for polypeptides comprising Cas9

GGTCATCTACTAGCCGCGCCG (SEQ ID NO: 2966): [Model Cell line information]: cell: NCIH460:
cancer type: LUNG: PAM dist: 12: indel length: 0: CRISPR gRNA ID: GF-CCELg9-878: [crRNA sequence]:
crRNA sequence: AGGTGGACATCTGGTCGGCTTGG (SEQ ID NO: 2973):
SpgRNA: attctaatacgactcactataggAGGTGGACATCTGGTCGGCTgttttagagctagaaatagcaagttaaaataaggctagtccgtt
atcaacttgaaaaagtggcaccgagtcggtgc (SEQ ID NO: 2974): [Target gene information]: Gene ID: 6794: Symbol:
STK11: Ensembl Transcript ID: EN5T00000326873.7: GRCh: 37: Chr: 19: [Target cancer mutation
information]: mut start: 1220706: mut end: 1220706: mut class: Missense Mutation: mut type: SNP: ref seq:
G: mut seq: T: mut aa: p.G242W: mutation info source: CCLE: ref target(-10 +10):
CTGGTCGGCTGGGGTCACCCT (SEQ ID NO: 2975): mut target(-10 +10):
CTGGTCGGCTTGGGTCACCCT (SEQ ID NO: 2976): [Model Cell line information]: cell: NCIH1563:
cancer type: LUNG: PAM dist: 0: indel length: 0: CRISPR gRNA ID: GF-CCELg9-879: [crRNA sequence]:
crRNA sequence: GGTGGACATCTGGTCGGCTTGGG (SEQ ID NO: 2977):
SpgRNA: attctaatacgactcactataggGGTGGACATCTGGTCGGCTTgttttagagctagaaatagcaagttaaaataaggctagtccgtt
atcaacttgaaaaagtggcaccgagtcggtgc (SEQ ID NO: 2978): [Target gene information]: Gene ID: 6794: Symbol:
STK11: Ensembl Transcript ID: EN5T00000326873.7: GRCh: 37: Chr: 19: [Target cancer mutation
information]: mut start: 1220706: mut end: 1220706: mut class: Missense Mutation: mut type: SNP: ref seq:
G: mut seq: T: mut aa: p.G242W: mutation info source: CCLE: ref target(-10 +10):
CTGGTCGGCTGGGGTCACCCT (SEQ ID NO: 2975): mut target(-10 +10):
CTGGTCGGCTTGGGTCACCCT (SEQ ID NO: 2976): [Model Cell line information]: cell: NCIH1563:
cancer type: LUNG: PAM dist: 1: indel length: 0: CRISPR gRNA ID: GF-CCELg9-880: [crRNA sequence]:
crRNA sequence: CCGGACCAGCCAGGGCTTCCGG (SEQ ID NO: 2979):
SpgRNA: attctaatacgactcactataggCCGGACCAGCCAGGGCTTCCgttttagagctagaaatagcaagttaaaataaggctagtccgtt
atcaacttgaaaaagtggcaccgagtcggtgc (SEQ ID NO: 2980): [Target gene information]: Gene ID: 6794: Symbol:
STK11: Ensembl Transcript ID: EN5T00000326873.7: GRCh: 37: Chr: 19: [Target cancer mutation
information]: mut start: 1220629: mut end: 1220629: mut class: Missense Mutation: mut type: SNP: ref seq:
C: mut seq: T: mut aa: p.5216F: mutation info source: CCLE: ref target(-10 +10):
AGCCAGGGCTCCCCGGCTTTC (SEQ ID NO: 2981): mut target(-10 +10):
AGCCAGGGCTTCCCGGCTTTC (SEQ ID NO: 2982): [Model Cell line information]: cell: NCIH1573:
cancer type: LUNG: PAM dist: 3: indel length: 0: CRISPR gRNA ID: GF-CCELg9-881: [crRNA sequence]:
crRNA sequence: GAAGCCCTGGCTGGTCCGGCAGG (SEQ ID NO: 2983):
SpgRNA: attctaatacgactcactataggGAAGCCCTGGCTGGTCCGGCgttttagagctagaaatagcaagttaaaataaggctagtccgtt
atcaacttgaaaaagtggcaccgagtcggtgc (SEQ ID NO: 2984): [Target gene information]: Gene ID: 6794: Symbol:
STK11: Ensembl Transcript ID: EN5T00000326873.7: GRCh: 37: Chr: 19: [Target cancer mutation
information]: mut start: 1220629: mut end: 1220629: mut class: Missense Mutation: mut type: SNP: ref seq:
C: mut seq: T: mut aa: p.5216F: mutation info source: CCLE: ref target(-10 +10):
AGCCAGGGCTCCCCGGCTTTC (SEQ ID NO: 2981): mut target(-10 +10):
AGCCAGGGCTTCCCGGCTTTC (SEQ ID NO: 2982): [Model Cell line information]: cell: NCIH1573:
cancer type: LUNG: PAM dist: 19: indel length: 0: CRISPR gRNA ID: GF-CCELg9-882: [crRNA sequence]:
crRNA sequence: GCTGGAAAGCCGGGAAGCCCTGG (SEQ ID NO: 2985):
SpgRNA: attctaatacgactcactataggGCTGGAAAGCCGGGAAGCCCgttttagagctagaaatagcaagttaaaataaggctagtccgt
tatcaacttgaaaaagtggcaccgagtcggtgc (SEQ ID NO: 2986): [Target gene information]: Gene ID: 6794: Symbol:
STK11: Ensembl Transcript ID: EN5T00000326873.7: GRCh: 37: Chr: 19: [Target cancer mutation
information]: mut start: 1220629: mut end: 1220629: mut class: Missense Mutation: mut type: SNP: ref seq:
C: mut seq: T: mut aa: p.5216F: mutation info source: CCLE: ref target(-10 +10):
AGCCAGGGCTCCCCGGCTTTC (SEQ ID NO: 2981): mut target(-10 +10):
AGCCAGGGCTTCCCGGCTTTC (SEQ ID NO: 2982): [Model Cell line information]: cell: NCIH1573:
cancer type: LUNG: PAM dist: 6: indel length: 0: CRISPR gRNA ID: GF-CCELg9-883: [crRNA sequence]:
crRNA sequence: GAAAGCCGGGAAGCCCTGGCTGG (SEQ ID NO: 2987):
SpgRNA: attctaatacgactcactataggGAAAGCCGGGAAGCCCTGGCgttttagagctagaaatagcaagttaaaataaggctagtccgt
tatcaacttgaaaaagtggcaccgagtcggtgc (SEQ ID NO: 2988): [Target gene information]: Gene ID: 6794: Symbol:
STK11: Ensembl Transcript ID: ENST00000326873.7: GRCh: 37: Chr: 19: [Target cancer mutation
information]: mut start: 1220629: mut end: 1220629: mut class: Missense Mutation: mut type: SNP: ref seq:
C: mut seq: T: mut aa: p.S216F: mutation info source: CCLE: ref target(-10 +10):
AGCCAGGGCTCCCCGGCTTTC (SEQ ID NO: 2981): mut target(-10 +10):
AGCCAGGGCTTCCCGGCTTTC (SEQ ID NO: 2982): [Model Cell line information]: cell: NCIH1573:
cancer type: LUNG: PAM dist: 10: indel length: 0: CRISPR gRNA ID: GF-CCELg9-884: [crRNA sequence]:
crRNA sequence: CCGGGAAGCCCTGGCTGGTCCGG (SEQ ID NO: 2989):
SpgRNA: attctaatacgactcactataggCCGGGAAGCCCTGGCTGGTCgttttagagctagaaatagcaagttaaaataaggctagtccgtt
atcaacttgaaaaagtggcaccgagtcggtgc (SEQ ID NO: 2990): [Target gene information]: Gene ID: 6794: Symbol:
STK11: Ensembl Transcript ID: EN5T00000326873.7: GRCh: 37: Chr: 19: [Target cancer mutation
information]: mut start: 1220629: mut end: 1220629: mut class: Missense Mutation: mut type: SNP: ref seq:
C: mut seq: T: mut aa: p.5216F: mutation info source: CCLE: ref target(-10 +10):
AGCCAGGGCTCCCCGGCTTTC (SEQ ID NO: 2981): mut target(-10 +10):
AGCCAGGGCTTCCCGGCTTTC (SEQ ID NO: 2982): [Model Cell line information]: cell: NCIH1573:
cancer type: LUNG: PAM dist: 15: indel length: 0: CRISPR gRNA ID: GF-CCELg9-885: [crRNA sequence]:
crRNA sequence: CCCACCGCGCCCCGGCCCCCGG (SEQ ID NO: 2991):
SpgRNA: attctaatacgactcactataggCCCACCGCGCCCCGGCCCCgttttagagctagaaatagcaagttaaaataaggctagtccgtt
atcaacttgaaaaagtggcaccgagtcggtgc (SEQ ID NO: 2992): [Target gene information]: Gene ID: 51684:
Symbol: SUFU: Ensembl Transcript ID: EN5T00000369902.3: GRCh: 37: Chr: 10: [Target cancer mutation
information]: mut start: 104263963: mut end: 104263963: mut class: Silent: mut type: SNP: ref seq: T: mut
seq: C: mut aa: p.P18P: mutation info source: CCLE: ref target(-10 +10): CCCCGGCCCCTGGCCCGACTG
(SEQ ID NO: 2993): mut target(-10 +10): CCCCGGCCCCCGGCCCGACTG (SEQ ID NO: 2994):
[Model Cell line information]: cell: HCC827GR5: cancer type: LUNG: PAM dist: 0: indel length: 0:
CRISPR gRNA ID: GF-CCELg9-886: [crRNA sequence]: crRNA sequence:
CCCCGGCCCGACTGCCCCCCCGG (SEQ ID NO: 2995):
SpgRNA: attctaatacgactcactataggCCCCGGCCCGACTGCCCCCgttttagagctagaaatagcaagttaaaataaggctagtccgtt
atcaacttgaaaaagtggcaccgagtcggtgc (SEQ ID NO: 2996): [Target gene information]: Gene ID: 51684:
Symbol: SUFU: Ensembl Transcript ID: EN5T00000369902.3: GRCh: 37: Chr: 10: [Target cancer mutation TABLE 7-continued Illustrative guide RNA sequences for polypeptides comprising Cas9 information]: mut start: 104263963: mut end: 104263963: mut class: Silent: mut type: SNP: ref seq: T: mut
seq: C: mut aa: p.P18P: mutation info source: CCLE: ref target(-10 +10): CCCCGGCCCCTGGCCCGACTG
(SEQ ID NO: 2993): mut target(-10 +10): CCCCGGCCCCCGGCCCGACTG (SEQ ID NO: 2994):
[Model Cell line information]: cell: HCC827GR5: cancer type: LUNG: PAM dist: 17: indel length: 0:
CRISPR gRNA ID: GF-CCELg9-887: [crRNA sequence]: crRNA sequence:
GCCGGGGGCCGGGGGCGCGGTGG (SEQ ID NO: 2997):
SpgRNA: attctaatacgactcactataggGCCGGGGGCCGGGGGCGCGGgttttagagctagaaatagcaagttaaaataaggctagtccg
ttatcaacttgaaaaagtggcaccgagtcggtgc (SEQ ID NO: 2998): [Target gene information]: Gene ID: 51684:
Symbol: SUFU: Ensembl Transcript ID: EN5T00000369902.3: GRCh: 37: Chr: 10: [Target cancer mutation
information]: mut start: 104263963: mut end: 104263963: mut class: Silent: mut type: SNP: ref seq: T: mut
seq: C: mut aa: p.P18P: mutation info source: CCLE: ref target(-10 +10): CCCCGGCCCCTGGCCCGACTG
(SEQ ID NO: 2993): mut target(-10 +10): CCCCGGCCCCCGGCCCGACTG (SEQ ID NO: 2994):
Model Cell line information]: cell: HCC827GR5: cancer type: LUNG: PAM dist: 17: indel length: 0:
CRISPR gRNA ID: GF-CCELg9-888: [crRNA sequence]: crRNA sequence:
GGCCGGGGGGCAGTCGGGCCGG (SEQ ID NO: 2999):
SpgRNA: attctaatacgactcactataggGGCCGGGGGGCAGTCGGGCCgttttagagctagaaatagcaagttaaaataaggctagtccgt
tatcaacttgaaaaagtggcaccgagtcggtgc (SEQ ID NO: 3000): [Target gene information]: Gene ID: 51684:
Symbol: SUFU: Ensembl Transcript ID: EN5T00000369902.3: GRCh: 37: Chr: 10: [Target cancer mutation
information]: mut start: 104263963: mut end: 104263963: mut class: Silent: mut type: SNP: ref seq: T: mut
seq: C: mut aa: p.P18P: mutation info source: CCLE: ref target(-10 +10): CCCCGGCCCCTGGCCCGACTG
(SEQ ID NO: 2993): mut target(-10 +10): CCCCGGCCCCCGGCCCGACTG (SEQ ID NO: 2994):
Model Cell line information]: cell: HCC827GR5: cancer type: LUNG: PAM dist: -1: indel length: 0:
CRISPR gRNA ID: GF-CCELg9-889: [crRNA sequence]: crRNA sequence:
GGGGCAGTCGGGCCGGGGGCCGG (SEQ ID NO: 3001):
SpgRNA: attctaatacgactcactataggGGGGCAGTCGGGCCGGGGGCgttttagagctagaaatagcaagttaaaataaggctagtccgt
tatcaacttgaaaaagtggcaccgagtcggtgc (SEQ ID NO: 3002): [Target gene information]: Gene ID: 51684:
Symbol: SUFU: Ensembl Transcript ID: EN5T00000369902.3: GRCh: 37: Chr: 10: [Target cancer mutation
information]: mut start: 104263963: mut end: 104263963: mut class: Silent: mut type: SNP: ref seq: T: mut
seq: C: mut aa: p.P18P: mutation info source: CCLE: ref target(-10 +10): CCCCGGCCCCTGGCCCGACTG
(SEQ ID NO: 2993): mut target(-10 +10): CCCCGGCCCCCGGCCCGACTG (SEQ ID NO: 2994):
Model Cell line information]: cell: HCC827GR5: cancer type: LUNG: PAM dist: 6: indel length: 0:
CRISPR gRNA ID: GF-CCELg9-890: [crRNA sequence]: crRNA sequence:
CGGGCCGGGGGCCGGGGGCGCGG (SEQ ID NO: 3003):
SpgRNA: attctaatacgactcactataggCGGGCCGGGGGCCGGGGGCGgttttagagctagaaatagcaagttaaaataaggctagtccg
ttatcaacttgaaaaagtggcaccgagtcggtgc (SEQ ID NO: 3004): [Target gene information]: Gene ID: 51684:
Symbol: SUFU: Ensembl Transcript ID: EN5T00000369902.3: GRCh: 37: Chr: 10: [Target cancer mutation
information]: mut start: 104263963: mut end: 104263963: mut class: Silent: mut type: SNP: ref seq: T: mut
seq: C: mut aa: p.P18P: mutation info source: CCLE: ref target(-10 +10): CCCCGGCCCCTGGCCCGACTG
(SEQ ID NO: 2993): mut target(-10 +10): CCCCGGCCCCCGGCCCGACTG (SEQ ID NO: 2994):
[Model Cell line information]: cell: HCC827GR5: cancer type: LUNG: PAM dist: 14: indel length: 0:
CRISPR gRNA ID: GF-CCELg9-891: [crRNA sequence]: crRNA sequence:
GCCGGGGGGGCAGTCGGGCCGGG (SEQ ID NO: 3005):
SpgRNA: attctaatacgactcactataggGCCGGGGGGGCAGTCGGGCCgttttagagctagaaatagcaagttaaaataaggctagtccgt
tatcaacttgaaaaagtggcaccgagtcggtgc (SEQ ID NO: 3006): [Target gene information]: Gene ID: 51684:
Symbol: SUFU: Ensembl Transcript ID: EN5T00000369902.3: GRCh: 37: Chr: 10: [Target cancer mutation
information]: mut start: 104263963: mut end: 104263963: mut class: Silent: mut type: SNP: ref seq: T: mut
seq: C: mut aa: p.P18P: mutation info source: CCLE: ref target(-10 +10): CCCCGGCCCCTGGCCCGACTG
(SEQ ID NO: 2993): mut target(-10 +10): CCCCGGCCCCCGGCCCGACTG (SEQ ID NO: 2994):
[Model Cell line information]: cell: HCC827GR5: cancer type: LUNG: PAM dist: 0: indel length: 0:
CRISPR gRNA ID: GF-CCELg9-892: [crRNA sequence]: crRNA sequence:
CCGGGGGGGCAGTCGGGCCGGGG (SEQ ID NO: 3007):
SpgRNA: attctaatacgactcactataggCCGGGGGGGCAGTCGGGCCgttttagagctagaaatagcaagttaaaataaggctagtccgt
tatcaacttgaaaaagtggcaccgagtcggtgc (SEQ ID NO: 3008): [Target gene information]: Gene ID: 51684:
Symbol: SUFU: Ensembl Transcript ID: EN5T00000369902.3: GRCh: 37: Chr: 10: [Target cancer mutation
information]: mut start: 104263963: mut end: 104263963: mut class: Silent: mut type: SNP: ref seq: T: mut
seq: C: mut aa: p.P18P: mutation info source: CCLE: ref target(-10 +10): CCCCGGCCCCTGGCCCGACTG
(SEQ ID NO: 2993): mut target(-10 +10): CCCCGGCCCCCGGCCCGACTG (SEQ ID NO: 2994):
[Model Cell line information]: cell: HCC827GR5: cancer type: LUNG: PAM dist: 1: indel length: 0:
CRISPR gRNA ID: GF-CCELg9-893: [crRNA sequence]: crRNA sequence:
CGGGGGGGCAGTCGGGCCGGGGG (SEQ ID NO: 3009):
SpgRNA: attctaatacgactcactataggCGGGGGGGCAGTCGGGCCGgttttagagctagaaatagcaagttaaaataaggctagtccgt
tatcaacttgaaaaagtggcaccgagtcggtgc (SEQ ID NO: 3010): [Target gene information]: Gene ID: 51684:
Symbol: SUFU: Ensembl Transcript ID: EN5T00000369902.3: GRCh: 37: Chr: 10: [Target cancer mutation
information]: mut start: 104263963: mut end: 104263963: mut class: Silent: mut type: SNP: ref seq: T: mut
seq: C: mut aa: p.P18P: mutation info source: CCLE: ref target(-10 +10): CCCCGGCCCCTGGCCCGACTG
(SEQ ID NO: 2993): mut target(-10 +10): CCCCGGCCCCCGGCCCGACTG (SEQ ID NO: 2994):
[Model Cell line information]: cell: HCC827GR5: cancer type: LUNG: PAM dist: 2: indel length: 0:
CRISPR gRNA ID: GF-CCELg9-894: [crRNA sequence]: crRNA sequence:
GGGCAGTCGGGCCGGGGGCCGGG (SEQ ID NO: 3011):
SpgRNA: attctaatacgactcactataggGGGCAGTCGGGCCGGGGGCCgttttagagctagaaatagcaagttaaaataaggctagtccgt
tatcaacttgaaaaagtggcaccgagtcggtgc (SEQ ID NO: 3012): [Target gene information]: Gene ID: 51684
Symbol: SUFU: Ensembl Transcript ID: EN5T00000369902.3: GRCh: 37: Chr: 10: [Target cancer mutatioi
information]: mut start: 104263963: mut end: 104263963: mut class: Silent: mut type: SNP: ref seq: T: mu
seq: C: mut aa: p.P18P: mutation info source: CCLE: ref target(-10 +10): CCCCGGCCCCTGGCCCGACT(
(SEQ ID NO: 2993): mut target(-10 +10): CCCCGGCCCCCGGCCCGACTG (SEQ ID NO: 2994)
[Model Cell line information]: cell: HCC827GR5: cancer type: LUNG: PAM dist: 7: indel length: 0
CRISPR gRNA ID: GF-CCELg9-895: [crRNA sequence]: crRNA sequence
GGCAGTCGGGCCGGGGGCCGGGG (SEQ ID NO: 3013)

TABLE 7-continued

Illustrative guide RNA sequences for polypeptides comprising Cas9

SpgRNA: attctaatacgactcactataggGGCAGTCGGGCCGGGGGCCGgttttagagctagaaatagcaagttaaaataaggctagtccg
tatcaacttgaaaaagtggcaccgagtcggtgc (SEQ ID NO: 3014): [Target gene information]: Gene ID: 51684
Symbol: SUFU: Ensembl Transcript ID: EN5T00000369902.3: GRCh: 37: Chr: 10: [Target cancer mutatioi
information]: mut start: 104263963: mut end: 104263963: mut class: Silent: mut type: SNP: ref seq: T: mu
seq: C: mut aa: p.P18P: mutation info source: CCLE: ref target(-10 +10): CCCCGGCCCCTGGCCCGACT(
(SEQ ID NO: 2993): mut target(-10 +10): CCCCGGCCCCCGGCCCGACTG (SEQ ID NO: 2994)
[Model Cell line information]: cell: HCC827GR5: cancer type: LUNG: PAM dist: 8: indel length: 0
CRISPR gRNA ID: GF-CCELg9-896: [crRNA sequence]: crRNA sequence
GCAGTCGGGCCGGGGGCCGGGG (SEQ ID NO: 3015)
SpgRNA: attctaatacgactcactataggGCAGTCGGGCCGGGGGCCGGgttttagagctagaaatagcaagttaaaataaggctagtccg
tatcaacttgaaaaagtggcaccgagtcggtgc (SEQ ID NO: 3016): [Target gene information]: Gene ID: 51684
Symbol: SUFU: Ensembl Transcript ID: EN5T00000369902.3: GRCh: 37: Chr: 10: [Target cancer mutatioi
information]: mut start: 104263963: mut end: 104263963: mut class: Silent: mut type: SNP: ref seq: T: mu
seq: C: mut aa: p.P18P: mutation info source: CCLE: ref target(-10 +10): CCCCGGCCCCTGGCCCGACT(
(SEQ ID NO: 2993): mut target(-10 +10): CCCCGGCCCCCGGCCCGACTG (SEQ ID NO: 2994)
[Model Cell line information]: cell: HCC827GR5: cancer type: LUNG: PAM dist: 9: indel length: 0
CRISPR gRNA ID: GF-CCELg9-897: [crRNA sequence]: crRNA sequence
CCGGGGGCCGGGGGCGCGGTGGG (SEQ ID NO: 3017)
SpgRNA: attctaatacgactcactataggCCGGGGGCCGGGGGCGCGGTgttttagagctagaaatagcaagttaaaataaggctagtccg
tatcaacttgaaaaagtggcaccgagtcggtgc (SEQ ID NO: 3018): [Target gene information]: Gene ID: 51684
Symbol: SUFU: Ensembl Transcript ID: EN5T00000369902.3: GRCh: 37: Chr: 10: [Target cancer mutatioi
information]: mut start: 104263963: mut end: 104263963: mut class: Silent: mut type: SNP: ref seq: T: mu
seq: C: mut aa: p.P18P: mutation info source: CCLE: ref target(-10 +10): CCCCGGCCCCTGGCCCGACT(
(SEQ ID NO: 2993): mut target(-10 +10): CCCCGGCCCCCGGCCCGACTG (SEQ ID NO: 2994)
[Model Cell line information]: cell: HCC827GR5: cancer type: LUNG: PAM dist: 18: indel length: 0
CRISPR gRNA ID: GF-CCELg9-898: [crRNA sequence]: crRNA sequence:
CGGGGGCCGGGGGCGCGGTGGGG (SEQ ID NO: 3019)
SpgRNA: attctaatacgactcactataggCGGGGGCCGGGGGCGCGGTGgttttagagctagaaatagcaagttaaaataaggctagtccgt
tatcaacttgaaaaagtggcaccgagtcggtgc (SEQ ID NO: 3020): [Target gene information]: Gene ID: 51684:
Symbol: SUFU: Ensembl Transcript ID: EN5T00000369902.3: GRCh: 37: Chr: 10: [Target cancer mutation
information]: mut start: 104263963: mut end: 104263963: mut class: Silent: mut type: SNP: ref seq: T: mut
seq: C: mut aa: p.P18P: mutation info source: CCLE: ref target(-10 +10): CCCCGGCCCCTGGCCCGACTG
(SEQ ID NO: 2993): mut target(-10 +10): CCCCGGCCCCCGGCCCGACTG (SEQ ID NO: 2994)
[Model Cell line information]: cell: HCC827GR5: cancer type: LUNG: PAM dist: 19: indel length: 0:
CRISPR gRNA ID: GF-CCELg9-899: [crRNA sequence]: crRNA sequence:
TTTGTCTCCATGGGAGTGGAAGG (SEQ ID NO: 3021):
SpgRNA: attctaatacgactcactataggTTTGTCTCCATGGGAGTGGAgttttagagctagaaatagcaagttaaaataaggctagtccgtt
atcaacttgaaaaagtggcaccgagtcggtgc (SEQ ID NO: 3022): [Target gene information]: Gene ID: 51684:
Symbol: SUFU: Ensembl Transcript ID: EN5T00000369902.3: GRCh: 37: Chr: 10: [Target cancer mutation
information]: mut start: 104377121: mut end: 104377121: mut class: Missense Mutation: mut type: SNP: ref
seq: C: mut seq: T: mut aa: p.T411M: mutation info source: CCLE: ref target(-10 +10):
TTTGTCTCCACGGGAGTGGAA (SEQ ID NO: 909): mut target(-10 +10):
TTTGTCTCCATGGGAGTGGAA (SEQ ID NO: 910): [Model Cell line information]: cell: A549: cancer
type: LUNG: PAM dist: 10: indel length: 0: CRISPR gRNA ID: GF-CCELg9-900: [crRNA sequence]:
crRNA sequence: GGCCATCACGTTTGTCTCCATGG (SEQ ID NO: 3023):
SpgRNA: attctaatacgactcactataggGGCCATCACGTTTGTCTCCAgttttagagctagaaatagcaagttaaaataaggctagtccgtt
atcaacttgaaaaagtggcaccgagtcggtgc (SEQ ID NO: 3024): [Target gene information]: Gene ID: 51684:
Symbol: SUFU: Ensembl Transcript ID: EN5T00000369902.3: GRCh: 37: Chr: 10: [Target cancer mutation
information]: mut start: 104377121: mut end: 104377121: mut class: Missense Mutation: mut type: SNP: ref
seq: C: mut seq: T: mut aa: p.T411M: mutation info source: CCLE: ref target(-10 +10):
TTTGTCTCCACGGGAGTGGAA (SEQ ID NO: 909): mut target(-10 +10):
TTTGTCTCCATGGGAGTGGAA (SEQ ID NO: 910): [Model Cell line information]: cell: A549: cancer
type: LUNG: PAM dist: 0: indel length: 0: CRISPR gRNA ID: GF-CCELg9-901: [crRNA sequence]: crRNA
sequence: CACGTTTGTCTCCATGGGAGTGG (SEQ ID NO: 3025):
SpgRNA: attctaatacgactcactataggCACGTTTGTCTCCATGGGAGgttttagagctagaaatagcaagttaaaataaggctagtccgtt
atcaacttgaaaaagtggcaccgagtcggtgc (SEQ ID NO: 3026): [Target gene information]: Gene ID: 51684:
Symbol: SUFU: Ensembl Transcript ID: EN5T00000369902.3: GRCh: 37: Chr: 10: [Target cancer mutation
information]: mut start: 104377121: mut end: 104377121: mut class: Missense Mutation: mut type: SNP: ref
seq: C: mut seq: T: mut aa: p.T411M: mutation info source: CCLE: ref target(-10 +10):
TTTGTCTCCACGGGAGTGGAA (SEQ ID NO: 909): mut target(-10 +10):
TTTGTCTCCATGGGAGTGGAA (SEQ ID NO: 910): [Model Cell line information]: cell: A549: cancer
type: LUNG: PAM dist: 6: indel length: 0: CRISPR gRNA ID: GF-CCELg9-902: [crRNA sequence]: crRNA
sequence: GCCATCACGTTTGTCTCCATGGG (SEQ ID NO: 3027):
SpgRNA: attctaatacgactcactataggGCCATCACGTTTGTCTCCATGttttagagctagaaatagcaagttaaaataaggctagtccgtta
tcaacttgaaaaagtggcaccgagtcggtgc (SEQ ID NO: 3028): [Target gene information]: Gene ID: 51684: Symbol:
SUFU: Ensembl Transcript ID: ENST00000369902.3: GRCh: 37: Chr: 10: [Target cancer mutation
information]: mut start: 104377121: mut end: 104377121: mut class: Missense Mutation: mut type: SNP: ref
seq: C: mut seq: T: mut aa: p.T411M: mutation info source: CCLE: ref target(-10 +10):
TTTGTCTCCACGGGAGTGGAA (SEQ ID NO: 909): mut target(-10 +10):
TTTGTCTCCATGGGAGTGGAA (SEQ ID NO: 910): [Model Cell line information]: cell: A549: cancer
type: LUNG: PAM dist: 1: indel length: 0: CRISPR gRNA ID: GF-CCELg9-903: [crRNA sequence]: crRNA
sequence: AAAGGCGCCTTCCACTCCCATGG (SEQ ID NO: 3029):
SpgRNA: attctaatacgactcactataggAAAGGCGCCTTCCACTCCCAgttttagagctagaaatagcaagttaaaataaggctagtccgtt
atcaacttgaaaaagtggcaccgagtcggtgc (SEQ ID NO: 3030): [Target gene information]: Gene ID: 51684:
Symbol: SUFU: Ensembl Transcript ID: EN5T00000369902.3: GRCh: 37: Chr: 10: [Target cancer mutation
information]: mut start: 104377121: mut end: 104377121: mut class: Missense Mutation: mut type: SNP: ref
seq: C: mut seq: T: mut aa: p.T411M: mutation info source: CCLE: ref target(-10 +10):
TTTGTCTCCACGGGAGTGGAA (SEQ ID NO: 909): mut target(-10 +10):

TABLE 7-continued

Illustrative guide RNA sequences for polypeptides comprising Cas9

TTTGTCTCCATGGGAGTGGAA (SEQ ID NO: 910): [Model Cell line information]: cell: A549: cancer type: LUNG: PAM dist: 1: indel length: 0: CRISPR gRNA ID: GF-CCELg9-904: [crRNA sequence]: crRNA sequence: TCCCATGGAGACAAACGTGATGG (SEQ ID NO: 3031):
SpgRNA: attctaatacgactcactataggTCCCATGGAGACAAACGTGAgttttagagctagaaatagcaagttaaaataaggctagtccgt tatcaacttgaaaaagtggcaccgagtcggtgc (SEQ ID NO: 3032): [Target gene information]: Gene ID: 51684: Symbol: SUFU: Ensembl Transcript ID: EN5T00000369902.3: GRCh: 37: Chr: 10: [Target cancer mutation information]: mut start: 104377121: mut end: 104377121: mut class: Missense Mutation: mut type: SNP: ref seq: C: mut seq: T: mut aa: p.T411M: mutation info source: CCLE: ref target(-10 +10):
TTTGTCTCCACGGGAGTGGAA (SEQ ID NO: 909): mut target(-10 +10):
TTTGTCTCCATGGGAGTGGAA (SEQ ID NO: 910): [Model Cell line information]: cell: A549: cancer type: LUNG: PAM dist: 16: indel length: 0: CRISPR gRNA ID: GF-CCELg9-905: [crRNA sequence]: crRNA sequence: AATGGAGAAAGATGTAACTTCGG (SEQ ID NO: 3033):
SpgRNA: attctaatacgactcactataggAATGGAGAAAGATGTAACTTgttttagagctagaaatagcaagttaaaataaggctagtccgt tatcaacttgaaaaagtggcaccgagtcggtgc (SEQ ID NO: 3034): [Target gene information]: Gene ID: 54790: Symbol: TET2: Ensembl Transcript ID: EN5T00000540549.1: GRCh: 37: Chr: 4: [Target cancer mutation information]: mut start: 106155466: mut end: 106155466: mut class: Missense Mutation: mut type: SNP: ref seq: C: mut seq: T: mut aa: p.R123C: mutation info source: CCLE: ref target(-10 +10):
TGGAGAAAGACGTAACTTCGG (SEQ ID NO: 913): mut target(-10 +10):
TGGAGAAAGATGTAACTTCGG (SEQ ID NO: 914): [Model Cell line information]: cell: NCIH661: cancer type: LUNG: PAM dist: 8: indel length: 0: CRISPR gRNA ID: GF-CCELg9-906: [crRNA sequence]: crRNA sequence: ATGGAGAAAGATGTAACTTCGGG (SEQ ID NO: 3035):
SpgRNA: attctaatacgactcactataggATGGAGAAAGATGTAACTTCGttttagagctagaaatagcaagttaaaataaggctagtccgtt atcaacttgaaaaagtggcaccgagtcggtgc (SEQ ID NO: 303 6): [Target gene information]: Gene ID: 54790: Symbol: TET2: Ensembl Transcript ID: EN5T00000540549.1: GRCh: 37: Chr: 4: [Target cancer mutation information]: mut start: 106155466: mut end: 106155466: mut class: Missense Mutation: mut type: SNP: ref seq: C: mut seq: T: mut aa: p.R123C: mutation info source: CCLE: ref target(-10 +10):
TGGAGAAAGACGTAACTTCGG (SEQ ID NO: 913): mut target(-10 +10):
TGGAGAAAGATGTAACTTCGG (SEQ ID NO: 914): [Model Cell line information]: cell: NCIH661: cancer type: LUNG: PAM dist: 9: indel length: 0: CRISPR gRNA ID: GF-CCELg9-907: [crRNA sequence]: crRNA sequence: TGGAGAAAGATGTAACTTCGGGG (SEQ ID NO: 3037):
SpgRNA: attctaatacgactcactataggTGGAGAAAGATGTAACTTCGgttttagagctagaaatagcaagttaaaataaggctagtccgtt atcaacttgaaaaagtggcaccgagtcggtgc (SEQ ID NO: 303 8): [Target gene information]: Gene ID: 54790: Symbol: TET2: Ensembl Transcript ID: EN5T00000540549.1: GRCh: 37: Chr: 4: [Target cancer mutation information]: mut start: 106155466: mut end: 106155466: mut class: Missense Mutation: mut type: SNP: ref seq: C: mut seq: T: mut aa: p.R123C: mutation info source: CCLE: ref target(-10 +10):
TGGAGAAAGACGTAACTTCGG (SEQ ID NO: 913): mut target(-10 +10):
TGGAGAAAGATGTAACTTCGG (SEQ ID NO: 914): [Model Cell line information]: cell: NCIH661: cancer type: LUNG: PAM dist: 10: indel length: 0: CRISPR gRNA ID: GF-CCELg9-908: [crRNA sequence]: crRNA sequence: ATCTTTCTCCATTAGCCTTTTGG (SEQ ID NO: 3039):
SpgRNA: attctaatacgactcactataggATCTTTCTCCATTAGCCTTgttttagagctagaaatagcaagttaaaataaggctagtccgttat caacttgaaaaagtggcaccgagtcggtgc (SEQ ID NO: 3040): [Target gene information]: Gene ID: 54790: Symbol: TET2: Ensembl Transcript ID: EN5T00000540549.1: GRCh: 37: Chr: 4: [Target cancer mutation information]: mut start: 106155466: mut end: 106155466: mut class: Missense Mutation: mut type: SNP: ref seq: C: mut seq: T: mut aa: p.R123C: mutation info source: CCLE: ref target(-10 +10):
TGGAGAAAGACGTAACTTCGG (SEQ ID NO: 913): mut target(-10 +10):
TGGAGAAAGATGTAACTTCGG (SEQ ID NO: 914): [Model Cell line information]: cell: NCIH661: cancer type: LUNG: PAM dist: 20: indel length: 0: CRISPR gRNA ID: GF-CCELg9-909: [crRNA sequence]: crRNA sequence: ATTCTTATCCTGGTGTGGGAAGG (SEQ ID NO: 3041):
SpgRNA: attctaatacgactcactataggATTCTTATCCTGGTGTGGGAgttttagagctagaaatagcaagttaaaataaggctagtccgtt atcaacttgaaaaagtggcaccgagtcggtgc (SEQ ID NO: 3042): [Target gene information]: Gene ID: 54790: Symbol: TET2: Ensembl Transcript ID: ENST00000540549.1: GRCh: 37: Chr: 4: [Target cancer mutation information]: mut start: 106164819: mut end: 106164819: mut class: Silent: mut type: SNP: ref seq: C: mut seq: T: mut aa: p.L1229L: mutation info source: CCLE: ref target(-10 +10):
TTGTGATTCTCATCCTGGTGT (SEQ ID NO: 3043): mut target(-10 +10):
TTGTGATTCTTATCCTGGTGT (SEQ ID NO: 3044): [Model Cell line information]: cell: HPAFII: cancer type: PANCREAS: PAM dist: 15: indel length: 0: CRISPR gRNA ID: GF-CCELg9-910: [crRNA sequence]: crRNA sequence: AGTGATTGTGATTCTTATCCTGG (SEQ ID NO: 3045):
SpgRNA: attctaatacgactcactataggAGTGATTGTGATTCTTATCCgttttagagctagaaatagcaagttaaaataaggctagtccgtta tcaacttgaaaaagtggcaccgagtcggtgc (SEQ ID NO: 3046): [Target gene information]: Gene ID: 54790: Symbol: TET2: Ensembl Transcript ID: EN5T00000540549.1: GRCh: 37: Chr: 4: [Target cancer mutation information]: mut start: 106164819: mut end: 106164819: mut class: Silent: mut type: SNP: ref seq: C: mut seq: T: mut aa: p.L1229L: mutation info source: CCLE: ref target(-10 +10):
TTGTGATTCTCATCCTGGTGT (SEQ ID NO: 3043): mut target(-10 +10):
TTGTGATTCTTATCCTGGTGT (SEQ ID NO: 3044): [Model Cell line information]: cell: HPAFII: cancer type: PANCREAS: PAM dist: 5: indel length: 0: CRISPR gRNA ID: GF-CCELg9-911: [crRNA sequence]: crRNA sequence: TTGTGATTCTTATCCTGGTGTGG (SEQ ID NO: 3047):
SpgRNA: attctaatacgactcactataggTTGTGATTCTTATCCTGGTGgttttagagctagaaatagcaagttaaaataaggctagtccgtta tcaacttgaaaaagtggcaccgagtcggtgc (SEQ ID NO: 3048): [Target gene information]: Gene ID: 54790: Symbol: TET2: Ensembl Transcript ID: EN5T00000540549.1: GRCh: 37: Chr: 4: [Target cancer mutation information]: mut start: 106164819: mut end: 106164819: mut class: Silent: mut type: SNP: ref seq: C: mut seq: T: mut aa: p.L1229L: mutation info source: CCLE: ref target(-10 +10):
TTGTGATTCTCATCCTGGTGT (SEQ ID NO: 3043): mut target(-10 +10):
TTGTGATTCTTATCCTGGTGT (SEQ ID NO: 3044): [Model Cell line information]: cell: HPAFII: cancer type: PANCREAS: PAM dist: 10: indel length: 0: CRISPR gRNA ID: GF-CCELg9-912: [crRNA sequence]: crRNA sequence: TGTGATTCTTATCCTGGTGTGGG (SEQ ID NO: 3049):
SpgRNA: attctaatacgactcactataggTGTGATTCTTATCCTGGTGTgttttagagctagaaatagcaagttaaaataaggctagtccgtta tcaacttgaaaaagtggcaccgagtcggtgc (SEQ ID NO: 3050): [Target gene information]: Gene ID: 54790: Symbol: TET2: Ensembl Transcript ID: EN5T00000540549.1: GRCh: 37: Chr: 4: [Target cancer mutation TABLE 7-continued Illustrative guide RNA sequences for polypeptides comprising Cas9 information]: mut start: 106164819: mut end: 106164819: mut class: Silent: mut type: SNP: ref seq: C: mut
seq: T: mut aa: p.L1229L: mutation info source: CCLE: ref target(-10 +10):
TTGTGATTCTCATCCTGGTGT (SEQ ID NO: 3043): mut target(-10 +10):
TTGTGATTCTTATCCTGGTGT (SEQ ID NO: 3044) [Model Cell line information]: cell: HPAFII: cancer
type: PANCREAS: PAM dist: 11: indel length: 0: CRISPR gRNA ID: GF-CCELg9-913: [crRNA sequence]:
crRNA sequence: TAGCATTGCAGCTCCGTTTACTGG (SEQ ID NO: 3051):
SpgRNA: attctaatacgactcactataggTAGCATTGCAGCTCGTTTACgttttagagctagaaatagcaagttaaaataaggctagtccgtt
atcaacttgaaaaagtggcaccgagtcggtgc (SEQ ID NO: 3052): [Target gene information]: Gene ID: 54790:
Symbol: TET2: Ensembl Transcript ID: EN5T00000540549.1: GRCh: 37: Chr: 4: [Target cancer mutation
information]: mut start: 106156019: mut end: 106156019: mut class: Missense Mutation: mut type: SNP: ref
seq: T: mut seq: G: mut aa: p.L307R: mutation info source: CCLE: ref target(-10 +10):
GCCAGTAAACTAGCTGCAATG (SEQ ID NO: 917): mut target(-10 +10):
GCCAGTAAACGAGCTGCAATG (SEQ ID NO: 918): [Model Cell line information]: cell: NCIH1573:
cancer type: LUNG: PAM dist: 7: indel length: 0: CRISPR gRNA ID: GF-CCELg9-914: [crRNA sequence]:
crRNA sequence: CAGCTAGGCTTACAGCATTGTGG (SEQ ID NO: 3053):
SpgRNA: attctaatacgactcactataggCAGCTAGGCTTACAGCATTGgttttagagctagaaatagcaagttaaaataaggctagtccgtt
atcaacttgaaaaagtggcaccgagtcggtgc (SEQ ID NO: 3054): [Target gene information]: Gene ID: 7046: Symbol:
TGFBR1: Ensembl Transcript ID: EN5T00000374994.4: GRCh: 37: Chr: 9: [Target cancer mutation
information]: mut start: 101911534: mut end: 101911534: mut class: Missense Mutation: mut type: SNP: ref
seq: C: mut seq: T: mut aa: p.R487W: mutation info source: CCLE: ref target(-10 +10):
TACAGCATTGCGGATTAAGAA (SEQ ID NO: 921): mut target(-10 +10):
TACAGCATTGTGGATTAAGAA (SEQ ID NO: 922): [Model Cell line information]: cell: NCIH1437:
cancer type: LUNG: PAM dist: 0: indel length: 0: CRISPR gRNA ID: GF-CCELg9-915: [crRNA sequence]:
crRNA sequence: TTTGAAATCAAAGAGTATCTTGG (SEQ ID NO: 3055):
SpgRNA: attctaatacgactcactataggTTTGAAATCAAAGAGTATCTgttttagagctagaaatagcaagttaaaataaggctagtccgtt
atcaacttgaaaaagtggcaccgagtcggtgc (SEQ ID NO: 3056): [Target gene information]: Gene ID: 7046: Symbol:
TGFBR1: Ensembl Transcript ID: EN5T00000374994.4: GRCh: 37: Chr: 9: [Target cancer mutation
information]: mut start: 101907053: mut end: 101907053: mut class: Missense Mutation: mut type: SNP: ref
seq: A: mut seq: G: mut aa: p.N338S: mutation info source: CCLE: ref target(-10 +10):
AAATCAAGAATATCTTGGTA (SEQ ID NO: 927): mut target(-10 +10):
AAATCAAGAGTATCTTGGTA (SEQ ID NO: 928): [Model Cell line information]: cell: HPAFII: cancer
type: PANCREAS: PAM dist: 6: indel length: 0: CRISPR gRNA ID: GF-CCELg9-916: [crRNA sequence]:
crRNA sequence: AGTATCTTGGTAAAGAAGAATGG (SEQ ID NO: 3057):
SpgRNA: attctaatacgactcactataggAGTATCTTGGTAAAGAAGAAgttttagagctagaaatagcaagttaaaataaggctagtccgt
tatcaacttgaaaaagtggcaccgagtcggtgc (SEQ ID NO: 3058): [Target gene information]: Gene ID: 7046: Symbol:
TGFBR1: Ensembl Transcript ID: ENST00000374994.4: GRCh: 37: Chr: 9: [Target cancer mutation
information]: mut start: 101907053: mut end: 101907053: mut class: Missense Mutation: mut type: SNP: ref
seq: A: mut seq: G: mut aa: p.N338S: mutation info source: CCLE: ref target(-10 +10):
AAATCAAGAATATCTTGGTA (SEQ ID NO: 927): mut target(-10 +10):
AAATCAAGAGTATCTTGGTA (SEQ ID NO: 928): [Model Cell line information]: cell: HPAFII: cancer
type: PANCREAS: PAM dist: 19: indel length: 0: CRISPR gRNA ID: GF-CCELg9-917: [crRNA sequence]:
crRNA sequence: ATGGTACTTGGACTTAGCTCTGG (SEQ ID NO: 3059):
SpgRNA: attctaatacgactcactataggATGGTACTTGGACTTAGCTCgttttagagctagaaatagcaagttaaaataaggctagtccgtt
atcaacttgaaaaagtggcaccgagtcggtgc (SEQ ID NO: 3060): [Target gene information]: Gene ID: 7046: Symbol:
TGFBR1: Ensembl Transcript ID: EN5T00000374994.4: GRCh: 37: Chr: 9: [Target cancer mutation
information]: mut start: 101904835: mut end: 101904835: mut class: Nonsense Mutation: mut type: SNP: ref
seq: C: mut seq: T: mut aa: p.Q275*: mutation info source: CCLE: ref target(-10 +10):
TACTTGGACTCAGCTCTGGTT (SEQ ID NO: 933): mut target(-10 +10):
TACTTGGACTTAGCTCTGGTT (SEQ ID NO: 934): [Model Cell line information]: cell: NCIH1573:
cancer type: LUNG: PAM dist: 6: indel length: 0: CRISPR gRNA ID: GF-CCELg9-918: [crRNA sequence]:
crRNA sequence: TACTTGGACTTAGCTCTGGTGG (SEQ ID NO: 3061):
SpgRNA: attctaatacgactcactataggTACTTGGACTTAGCTCTGGTgttttagagctagaaatagcaagttaaaataaggctagtccgtta
tcaacttgaaaaagtggcaccgagtcggtgc (SEQ ID NO: 3062): [Target gene information]: Gene ID: 7046: Symbol:
TGFBR1: Ensembl Transcript ID: EN5T00000374994.4: GRCh: 37: Chr: 9: [Target cancer mutation
information]: mut start: 101904835: mut end: 101904835: mut class: Nonsense Mutation: mut type: SNP: ref
seq: C: mut seq: T: mut aa: p.Q275*: mutation info source: CCLE: ref target(-10 +10):
TACTTGGACTCAGCTCTGGTT (SEQ ID NO: 933): mut target(-10 +10):
TACTTGGACTTAGCTCTGGTT (SEQ ID NO: 934): [Model Cell line information]: cell: NCIH1573:
cancer type: LUNG: PAM dist: 10: indel length: 0: CRISPR gRNA ID: GF-CCELg9-919: [crRNA sequence]:
crRNA sequence: ACACGCACCTCAAAGCTGTTCGG (SEQ ID NO: 3063):
SpgRNA: attctaatacgactcactataggACACGCACCTCAAAGCTGTTgttttagagctagaaatagcaagttaaaataaggctagtccgtt
atcaacttgaaaaagtggcaccgagtcggtgc (SEQ ID NO: 3064): [Target gene information]: Gene ID: 7157: Symbol:
TP53: Ensembl Transcript ID: EN5T00000269305.4: GRCh: 37: Chr: 17: [Target cancer mutation
information]: mut start: 7577138: mut end: 7577138: mut class: Missense Mutation: mut type: SNP: ref seq:
C: mut seq: G: mut aa: p.R267P: mutation info source: CCLE: ref target(-10 +10):
AAAGCTGTTCCGTCCCAGTAG (SEQ ID NO: 3065): mut target(-10 +10):
AAAGCTGTTCGGTCCCAGTAG (SEQ ID NO: 3066): [Model Cell line information]: cell: NCIH1437:
cancer type: LUNG: PAM dist: -1: indel length: 0: CRISPR gRNA ID: GF-CCELg9-920: [crRNA sequence]:
crRNA sequence: ACTGGGACCCGAACAGCTTTGAGG (SEQ ID NO: 3067):
SpgRNA: attctaatacgactcactataggACTGGGACCGAACAGCTTTGgttttagagctagaaatagcaagttaaaataaggctagtccgtt
atcaacttgaaaaagtggcaccgagtcggtgc (SEQ ID NO: 3068): [Target gene information]: Gene ID: 7157: Symbol:
TP53: Ensembl Transcript ID: EN5T00000269305.4: GRCh: 37: Chr: 17: [Target cancer mutation
information]: mut start: 7577138: mut end: 7577138: mut class: Missense Mutation: mut type: SNP: ref seq:
C: mut seq: G: mut aa: p.R267P: mutation info source: CCLE: ref target(-10 +10):
AAAGCTGTTCCGTCCCAGTAG (SEQ ID NO: 3065): mut target(-10 +10):
AAAGCTGTTCGGTCCCAGTAG (SEQ ID NO: 3066): [Model Cell line information]: cell: NCIH1437:
cancer type: LUNG: PAM dist: 12: indel length: 0: CRISPR gRNA ID: GF-CCELg9-921: [crRNA sequence]:
crRNA sequence: GGTACAGTCAGAGCCAACCCCAGG (SEQ ID NO: 3069):

TABLE 7-continued

Illustrative guide RNA sequences for polypeptides comprising Cas9

SpgRNA: attctaatacgactcactataggGGTACAGTCAGAGCCAACCCgttttagagctagaaatagcaagttaaaataaggctagtccgt
tatcaacttgaaaaagtggcaccgagtcggtgc (SEQ ID NO: 3070): [Target gene information]: Gene ID: 7157: Symbol:
TP53: Ensembl Transcript ID: EN5T00000269305.4: GRCh: 37: Chr: 17: [Target cancer mutation
informa-
tion]: mut start: 7577610: mut end: 7577610: mut class: Splice Site: mut type: SNP: ref seq: T: mut
seq: C: mut aa: -: mutation info source: CCLE: ref target(-10 +10): AGAGCCAACCTAGGAGATAAC (SEQ
ID NO: 3071): mut target(-10 +10): AGAGCCAACCCAGGAGATAAC (SEQ ID NO: 3072): [Model Cell
line information]: cell: NCIH1650: cancer type: LUNG: PAM dist: 1: indel length: 0: CRISPR gRNA ID:
GF-CCELg9-922: [crRNA sequence]: crRNA sequence: GCCAACCCAGGAGATAACACAGG (SEQ ID
NO: 3073):
SpgRNA: attctaatacgactcactataggGCCAACCCAGGAGATAACACgagagctagaaatagcaagttaaaataaggctagtccgt
tatcaacttgaaaaagtggcaccgagtcggtgc (SEQ ID NO: 3074): [Target gene information]: Gene ID: 7157: Symbol:
TP53: Ensembl Transcript ID: EN5T00000269305.4: GRCh: 37: Chr: 17: [Target cancer mutation
informa-
tion]: mut start: 7577610: mut end: 7577610: mut class: Splice Site: mut type: SNP: ref seq: T: mut
seq: C: mut aa: -: mutation info source: CCLE: ref target(-10 +10): AGAGCCAACCTAGGAGATAAC (SEQ
ID NO: 3071): mut target(-10 +10): AGAGCCAACCCAGGAGATAAC (SEQ ID NO: 3072): [Model Cell
line information]: cell: NCIH1650: cancer type: LUNG: PAM dist: 13: indel length: 0: CRISPR gRNA ID:
GF-CCELg9-923: [crRNA sequence]: crRNA sequence: CTTGGGCCTGTGTTATCTCCTGG (SEQ ID NO:
3075):
SpgRNA: attctaatacgactcactataggCTTGGGCCTGTGTTATCTCCgttttagagctagaaatagcaagttaaaataaggctagtccgtta
tcaacttgaaaaagtggcaccgagtcggtgc (SEQ ID NO: 3076): [Target gene information]: Gene ID: 7157: Symbol:
TP53: Ensembl Transcript ID: EN5T00000269305.4: GRCh: 37: Chr: 17: [Target cancer mutation
informa-
tion]: mut start: 7577610: mut end: 7577610: mut class: Splice Site: mut type: SNP: ref seq: T: mut
seq: C: mut aa: -: mutation info source: CCLE: ref target(-10 +10): AGAGCCAACCTAGGAGATAAC (SEQ
ID NO: 3071): mut target(-10 +10): AGAGCCAACCCAGGAGATAAC (SEQ ID NO: 3072): [Model Cell
line information]: cell: NCIH1650: cancer type: LUNG: PAM dist: -1: indel length: 0: CRISPR gRNA ID:
GF-CCELg9-924: [crRNA sequence]: crRNA sequence: GCCTGTGTTATCTCCTGGGTTGG (SEQ ID NO:
3077):
SpgRNA: attctaatacgactcactataggGCCTGTGTTATCTCCTGGGTgttttagagctagaaatagcaagttaaaataaggctagtccgtta
tcaacttgaaaaagtggcaccgagtcggtgc (SEQ ID NO: 3078): [Target gene information]: Gene ID: 7157: Symbol:
TP53: Ensembl Transcript ID: EN5T00000269305.4: GRCh: 37: Chr: 17: [Target cancer mutation
informa-
tion]: mut start: 7577610: mut end: 7577610: mut class: Splice Site: mut type: SNP: ref seq: T: mut
seq: C: mut aa: -: mutation info source: CCLE: ref target(-10 +10): AGAGCCAACCTAGGAGATAAC (SEQ
ID NO: 3071): mut target(-10 +10): AGAGCCAACCCAGGAGATAAC (SEQ ID NO: 3072): [Model Cell
line information]: cell: NCIH1650: cancer type: LUNG: PAM dist: 4: indel length: 0: CRISPR gRNA ID:
GF-CCELg9-925: [crRNA sequence]: crRNA sequence: TTGGGCCTGTGTTATCTCCTGGG (SEQ ID NO:
3079):
SpgRNA: attctaatacgactcactataggTTGGGCCTGTGTTATCTCCTgttttagagctagaaatagcaagttaaaataaggctagtccgtta
tcaacttgaaaaagtggcaccgagtcggtgc (SEQ ID NO: 3080): [Target gene information]: Gene ID: 7157: Symbol:
TP53: Ensembl Transcript ID: EN5T00000269305.4: GRCh: 37: Chr: 17: [Target cancer mutation
informa-
tion]: mut start: 7577610: mut end: 7577610: mut class: Splice Site: mut type: SNP: ref seq: T: mut
seq: C: mut aa: -: mutation info source: CCLE: ref target(-10 +10): AGAGCCAACCTAGGAGATAAC (SEQ
ID NO: 3071): mut target(-10 +10): AGAGCCAACCCAGGAGATAAC (SEQ ID NO: 3072): [Model Cell
line information]: cell: NCIH1650: cancer type: LUNG: PAM dist: 0: indel length: 0: CRISPR gRNA ID:
GF-CCELg9-926: [crRNA sequence]: crRNA sequence: AAACACTTTTCGACATATTGTGG (SEQ ID NO:
3081):
SpgRNA: attctaatacgactcactataggAAACACTTTTCGACATATTGgttttagagctagaaatagcaagttaaaataaggctagtccgtt
atcaacttgaaaaagtggcaccgagtcggtgc (SEQ ID NO: 3082): [Target gene information]: Gene ID: 7157: Symbol:
TP53: Ensembl Transcript ID: EN5T00000269305.4: GRCh: 37: Chr: 17: [Target cancer mutation
information]: mut start: 7578205: mut end: 7578205: mut class: Missense Mutation: mut type: SNP: ref seq:
C: mut seq: A: mut aa: p.S215I: mutation info source: CCLE: ref target(-10 +10):
CACCACCACACTATGTCGAAA (SEQ ID NO: 93): mut target(-10 +10):
CACCACCACAATATGTCGAAA (SEQ ID NO: 96): [Model Cell line information]: cell: NCIH661:
cancer type: LUNG: PAM dist: 3: indel length: 0: CRISPR gRNA ID: GF-CCELg9-927: [crRNA sequence]:
crRNA sequence: CACTTTTCGACATATTGTGGTGG (SEQ ID NO: 3083):
SpgRNA: attctaatacgactcactataggCACTTTTCGACATATTGTGGgttttagagctagaaatagcaagttaaaataaggctagtccgtta
tcaacttgaaaaagtggcaccgagtcggtgc (SEQ ID NO: 3084): [Target gene information]: Gene ID: 7157: Symbol:
TP53: Ensembl Transcript ID: EN5T00000269305.4: GRCh: 37: Chr: 17: [Target cancer mutation
information]: mut start: 7578205: mut end: 7578205: mut class: Missense Mutation: mut type: SNP: ref seq:
C: mut seq: A: mut aa: p.S215I: mutation info source: CCLE: ref target(-10 +10):
CACCACCACACTATGTCGAAA (SEQ ID NO: 93): mut target(-10 +10):
CACCACCACAATATGTCGAAA (SEQ ID NO: 96): [Model Cell line information]: cell: NCIH661:
cancer type: LUNG: PAM dist: 6: indel length: 0: CRISPR gRNA ID: GF-CCELg9-928: [crRNA sequence]:
crRNA sequence: GCTTGTAGATGGCCATGGCGAGG (SEQ ID NO: 3085):
SpgRNA: attctaatacgactcactataggGCTTGTAGATGGCCATGGCGgttttagagctagaaatagcaagttaaaataaggctagtccgtt
atcaacttgaaaaagtggcaccgagtcggtgc (SEQ ID NO: 3086): [Target gene information]: Gene ID: 7157: Symbol:
TP53: Ensembl Transcript ID: EN5T00000269305.4: GRCh: 37: Chr: 17: [Target cancer mutation
information]: mut start: 7578457: mut end: 7578457: mut class: Missense Mutation: mut type: SNP: ref seq:
C: mut seq: A: mut aa: p.R158L: mutation info source: CCLE: ref target(-10 +10):
GGCCATGGCGCGGACGCGGGT (SEQ ID NO: 3087): mut target(-10 +10):
GGCCATGGCGAGGACGCGGGT (SEQ ID NO: 3088): [Model Cell line information]: cell: NCIH661:
cancer type: LUNG: PAM dist: 0: indel length: 0: CRISPR gRNA ID: GF-CCELg9-929: [crRNA sequence]:
crRNA sequence: AGATGGCCATGGCGAGGACGCGG (SEQ ID NO: 3089):

TABLE 7-continued

Illustrative guide RNA sequences for polypeptides comprising Cas9

SpgRNA: attctaatacgactcactataggAGATGGCCATGGCGAGGACGgttttagagctagaaatagcaagttaaaataaggctagtccgt
tatcaacttgaaaaagtggcaccgagtcggtgc (SEQ ID NO: 3090): [Target gene information]: Gene ID: 7157: Symbol:
TP53: Ensembl Transcript ID: EN5T00000269305.4: GRCh: 37: Chr: 17: [Target cancer mutation
information]: mut start: 7578457: mut end: 7578457: mut class: Missense Mutation: mut type: SNP: ref seq:
C: mut seq: A: mut aa: p.R158L: mutation info source: CCLE: ref target(-10 +10):
GGCCATGGCGCGGACGCGGGT (SEQ ID NO: 3087): mut target(-10 +10):
GGCCATGGCGAGGACGCGGGT (SEQ ID NO: 3088): [Model Cell line information]: cell: NCIH661:
cancer type: LUNG: PAM dist: 6: indel length: 0: CRISPR gRNA ID: GF-CCELg9-930: [crRNA sequence]:
crRNA sequence: CATGGCGAGGACGCGGGTGCCGG (SEQ ID NO: 3091):
SpgRNA: attctaatacgactcactataggCATGGCGAGGACGCGGGTGCgttttagagctagaaatagcaagttaaaataaggctagtccgt
tatcaacttgaaaaagtggcaccgagtcggtgc (SEQ ID NO: 3092): [Target gene information]: Gene ID: 7157: Symbol:
TP53: Ensembl Transcript ID: EN5T00000269305.4: GRCh: 37: Chr: 17: [Target cancer mutation
information]: mut start: 7578457: mut end: 7578457: mut class: Missense Mutation: mut type: SNP: ref seq:
C: mut seq: A: mut aa: p.R158L: mutation info source: CCLE: ref target(-10 +10):
GGCCATGGCGCGGACGCGGGT (SEQ ID NO: 3087): mut target(-10 +10):
GGCCATGGCGAGGACGCGGGT (SEQ ID NO: 3088): [Model Cell line information]: cell: NCIH661:
cancer type: LUNG: PAM dist: 13: indel length: 0: CRISPR gRNA ID: GF-CCELg9-931: [crRNA sequence]:
crRNA sequence: GCGAGGACGCGGGTGCCGGGCGG (SEQ ID NO: 3093):
SpgRNA: attctaatacgactcactataggGCGAGGACGCGGGTGCCGGGCGgttttagagctagaaatagcaagttaaaataaggctagtccgt
tatcaacttgaaaaagtggcaccgagtcggtgc (SEQ ID NO: 3094): [Target gene information]: Gene ID: 7157: Symbol:
TP53: Ensembl Transcript ID: ENST00000269305.4: GRCh: 37: Chr: 17: [Target cancer mutation
information]: mut start: 7578457: mut end: 7578457: mut class: Missense Mutation: mut type: SNP: ref seq:
C: mut seq: A: mut aa: p.R158L: mutation info source: CCLE: ref target(-10 +10):
GGCCATGGCGCGGACGCGGGT (SEQ ID NO: 3087): mut target(-10 +10):
GGCCATGGCGAGGACGCGGGT (SEQ ID NO: 3088): [Model Cell line information]: cell: NCIH661:
cancer type: LUNG: PAM dist: 17: indel length: 0: CRISPR gRNA ID: GF-CCELg9-932: [crRNA sequence]:
crRNA sequence: GATGGCCATGGCGAGGACGCGGG (SEQ ID NO: 3095):
SpgRNA: attctaatacgactcactataggGATGGCCATGGCGAGGACGCGgttttagagctagaaatagcaagttaaaataaggctagtccgt
tatcaacttgaaaaagtggcaccgagtcggtgc (SEQ ID NO: 3096): [Target gene information]: Gene ID: 7157: Symbol:
TP53: Ensembl Transcript ID: EN5T00000269305.4: GRCh: 37: Chr: 17: [Target cancer mutation
information]: mut start: 7578457: mut end: 7578457: mut class: Missense Mutation: mut type: SNP: ref seq:
C: mut seq: A: mut aa: p.R158L: mutation info source: CCLE: ref target(-10 +10):
GGCCATGGCGCGGACGCGGGT (SEQ ID NO: 3087): mut target(-10 +10):
GGCCATGGCGAGGACGCGGGT (SEQ ID NO: 3088): [Model Cell line information]: cell: NCIH661:
cancer type: LUNG: PAM dist: 7: indel length: 0: CRISPR gRNA ID: GF-CCELg9-933: [crRNA sequence]:
crRNA sequence: ATGGCGAGGACGCGGGTGCCGG (SEQ ID NO: 3097):
SpgRNA: attctaatacgactcactataggATGGCGAGGACGCGGGTGCCgttttagagctagaaatagcaagttaaaataaggctagtccgt
tatcaacttgaaaaagtggcaccgagtcggtgc (SEQ ID NO: 3098): [Target gene information]: Gene ID: 7157: Symbol:
TP53: Ensembl Transcript ID: EN5T00000269305.4: GRCh: 37: Chr: 17: [Target cancer mutation
information]: mut start: 7578457: mut end: 7578457: mut class: Missense Mutation: mut type: SNP: ref seq:
C: mut seq: A: mut aa: p.R158L: mutation info source: CCLE: ref target(-10 +10):
GGCCATGGCGCGGACGCGGGT (SEQ ID NO: 3087): mut target(-10 +10):
GGCCATGGCGAGGACGCGGGT (SEQ ID NO: 3088): [Model Cell line information]: cell: NCIH661:
cancer type: LUNG: PAM dist: 14: indel length: 0: CRISPR gRNA ID: GF-CCELg9-934: [crRNA sequence]:
crRNA sequence: CGAGGACGCGGGTGCCGGGCGGG (SEQ ID NO: 3099):
SpgRNA: attctaatacgactcactataggCGAGGACGCGGGTGCCGGGCgttttagagctagaaatagcaagttaaaataaggctagtccgt
tatcaacttgaaaaagtggcaccgagtcggtgc (SEQ ID NO: 3100): [Target gene information]: Gene ID: 7157: Symbol:
TP53: Ensembl Transcript ID: EN5T00000269305.4: GRCh: 37: Chr: 17: [Target cancer mutation
information]: mut start: 7578457: mut end: 7578457: mut class: Missense Mutation: mut type: SNP: ref seq:
C: mut seq: A: mut aa: p.R158L: mutation info source: CCLE: ref target(-10 +10):
GGCCATGGCGCGGACGCGGGT (SEQ ID NO: 3087): mut target(-10 +10):
GGCCATGGCGAGGACGCGGGT (SEQ ID NO: 3088): [Model Cell line information]: cell: NCIH661:
cancer type: LUNG: PAM dist: 18: indel length: 0: CRISPR gRNA ID: GF-CCELg9-935: [crRNA sequence]:
crRNA sequence: GAGGACGCGGGTGCCGGGCGGG (SEQ ID NO: 3101):
SpgRNA: attctaatacgactcactataggGAGGACGCGGGTGCCGGGCGgttttagagctagaaatagcaagttaaaataaggctagtccgt
tatcaacttgaaaaagtggcaccgagtcggtgc (SEQ ID NO: 3102): [Target gene information]: Gene ID: 7157: Symbol:
TP53: Ensembl Transcript ID: EN5T00000269305.4: GRCh: 37: Chr: 17: [Target cancer mutation
information]: mut start: 7578457: mut end: 7578457: mut class: Missense Mutation: mut type: SNP: ref seq:
C: mut seq: A: mut aa: p.R158L: mutation info source: CCLE: ref target(-10 +10):
GGCCATGGCGCGGACGCGGGT (SEQ ID NO: 3087): mut target(-10 +10):
GGCCATGGCGAGGACGCGGGT (SEQ ID NO: 3088): [Model Cell line information]: cell: NCIH661:
cancer type: LUNG: PAM dist: 19: indel length: 0: CRISPR gRNA ID: GF-CCELg9-936: [crRNA sequence]:
crRNA sequence: AGGACGCGGGTGCCGGGCGGGG (SEQ ID NO: 3103):
SpgRNA: attctaatacgactcactataggAGGACGCGGGTGCCGGGCGGgttttagagctagaaatagcaagttaaaataaggctagtccgt
tatcaacttgaaaaagtggcaccgagtcggtgc (SEQ ID NO: 3104): [Target gene information]: Gene ID: 7157: Symbol:
TP53: Ensembl Transcript ID: EN5T00000269305.4: GRCh: 37: Chr: 17: [Target cancer mutation
information]: mut start: 7578457: mut end: 7578457: mut class: Missense Mutation: mut type: SNP: ref seq:
C: mut seq: A: mut aa: p.R158L: mutation info source: CCLE: ref target(-10 +10):
GGCCATGGCGCGGACGCGGGT (SEQ ID NO: 3087): mut target(-10 +10):
GGCCATGGCGAGGACGCGGGT (SEQ ID NO: 3088): [Model Cell line information]: cell: NCIH661:
cancer type: LUNG: PAM dist: 20: indel length: 0: CRISPR gRNA ID: GF-CCELg9-937: [crRNA sequence]:
crRNA sequence: CGGCACCCGCGTCCTCGCCATGG (SEQ ID NO: 3105):
SpgRNA: attctaatacgactcactataggCGGCACCCGCGTCCTCGCCAgttttagagctagaaatagcaagttaaaataaggctagtccgtt
atcaacttgaaaaagtggcaccgagtcggtgc (SEQ ID NO: 3106): [Target gene information]: Gene ID: 7157: Symbol:
TP53: Ensembl Transcript ID: EN5T00000269305.4: GRCh: 37: Chr: 17: [Target cancer mutation
information]: mut start: 7578457: mut end: 7578457: mut class: Missense Mutation: mut type: SNP: ref seq:
C: mut seq: A: mut aa: p.R158L: mutation info source: CCLE: ref target(-10 +10):
GGCCATGGCGCGGACGCGGGT (SEQ ID NO: 3087): mut target(-10 +10):

TABLE 7-continued

Illustrative guide RNA sequences for polypeptides comprising Cas9

```
GGCCATGGCGAGGACGCGGGT (SEQ ID NO: 3088): [Model Cell line information]: cell: NCIH661:
cancer type: LUNG: PAM dist: 6: indel length: 0: CRISPR gRNA ID: GF-CCELg9-938: [crRNA sequence]:
crRNA sequence: GTGCATGTTTGTGCCTGTCCTGG (SEQ ID NO: 3107):
SpgRNA: attctaatacgactcactataggGTGCATGTTTGTGCCTGTCCgttttagagctagaaatagcaagttaaaataaggctagtccgtta
tcaacttgaaaaagtggcaccgagtcggtgc (SEQ ID NO: 3108): [Target gene information]: Gene ID: 7157: Symbol:
TP53: Ensembl Transcript ID: EN5T00000269305.4: GRCh: 37: Chr: 17: [Target cancer mutation
information]: mut start: 7577120: mut end: 7577120: mut class: Missense Mutation: mut type: SNP: ref seq:
C: mut seq: T: mut aa: p.R273H: mutation info source: CCLE: ref target(-10 +10):
GGCACAAACACGCACCTCAAA (SEQ ID NO: 941): mut target(-10 +10):
GGCACAAACATGCACCTCAAA (SEQ ID NO: 942): [Model Cell line information]: cell: NCIH1975:
cancer type: LUNG: PAM dist: 16: indel length: 0: CRISPR gRNA ID: GF-CCELg9-939: [crRNA sequence]:
crRNA sequence: TGCATGTTTGTGCCTGTCCTGGG (SEQ ID NO: 3109):
SpgRNA: attctaatacgactcactataggTGCATGTTTGTGCCTGTCCTgttttagagctagaaatagcaagttaaaataaggctagtccgtta
tcaacttgaaaaagtggcaccgagtcggtgc (SEQ ID NO: 3110): [Target gene information]: Gene ID: 7157: Symbol:
TP53: Ensembl Transcript ID: EN5T00000269305.4: GRCh: 37: Chr: 17: [Target cancer mutation
information]: mut start: 7577120: mut end: 7577120: mut class: Missense Mutation: mut type: SNP: ref seq:
C: mut seq: T: mut aa: p.R273H: mutation info source: CCLE: ref target(-10 +10):
GGCACAAACACGCACCTCAAA (SEQ ID NO: 941): mut target(-10 +10):
GGCACAAACATGCACCTCAAA (SEQ ID NO: 942): [Model Cell line information]: cell: NCIH1975:
cancer type: LUNG: PAM dist: 17: indel length: 0: CRISPR gRNA ID: GF-CCELg9-940: [crRNA sequence]:
crRNA sequence: TCCGGTTCATGCCGCCCATGCGG (SEQ ID NO: 103):
SpgRNA: attctaatacgactcactataggTCCGGTTCATGCCGCCCATGgttttagagctagaaatagcaagttaaaataaggctagtccgtt
atcaacttgaaaaagtggcaccgagtcggtgc (SEQ ID NO: 111): [Target gene information]: Gene ID: 7157: Symbol:
TP53: Ensembl Transcript ID: EN5T00000269305.4: GRCh: 37: Chr: 17: [Target cancer mutation
information]: mut start: 7577557: mut end: 7577557: mut class: Missense Mutation: mut type: SNP: ref seq:
A: mut seq: G: mut aa: p.C242R: mutation info source: CCLE: ref target(-10 +10):
CCGCCCATGCAGGAACTGTTA (SEQ ID NO: 106): mut target(-10 +10):
CCGCCCATGCGGGAACTGTTA (SEQ ID NO: 108): [Model Cell line information]: cell: CFPAC1:
cancer type: PANCREAS: PAM dist: -1: indel length: 0: CRISPR gRNA ID: GF-CCELg9-941: [crRNA
sequence]: crRNA sequence: CCGGTTCATGCCGCCCATGCGGG (SEQ ID NO: 3111):
SpgRNA: attctaatacgactcactataggCCGGTTCATGCCGCCCATGCgttttagagctagaaatagcaagttaaaataaggctagtccgtt
atcaacttgaaaaagtggcaccgagtcggtgc (SEQ ID NO: 3112): [Target gene information]: Gene ID: 7157: Symbol:
TP53: Ensembl Transcript ID: EN5T00000269305.4: GRCh: 37: Chr: 17: [Target cancer mutation
information]: mut start: 7577557: mut end: 7577557: mut class: Missense Mutation: mut type: SNP: ref seq:
A: mut seq: G: mut aa: p.C242R: mutation info source: CCLE: ref target(-10 +10):
CCGCCCATGCAGGAACTGTTA (SEQ ID NO: 106): mut target(-10 +10):
CCGCCCATGCGGGAACTGTTA (SEQ ID NO: 108): [Model Cell line information]: cell: CFPAC1:
%._ik.,ait o Liu.
cancer type: PANCREAS: PAM dist: 0: indel length: 0: CRISPR gRNA ID: GF-CCELg9-942: [crRNA
sequence]: crRNA sequence: CATGTGTAACAGTTCCCGCATGG (SEQ ID NO: 3113):
SpgRNA: attctaatacgactcactataggCATGTGTAACAGTTCCCGCAgttttagagctagaaatagcaagttaaaataaggctagtccgtt
atcaacttgaaaaagtggcaccgagtcggtgc (SEQ ID NO: 3114): [Target gene information]: Gene ID: 7157: Symbol:
TP53: Ensembl Transcript ID: EN5T00000269305.4: GRCh: 37: Chr: 17: [Target cancer mutation
information]: mut start: 7577557: mut end: 7577557: mut class: Missense Mutation: mut type: SNP: ref seq:
A: mut seq: G: mut aa: p.C242R: mutation info source: CCLE: ref target(-10 +10):
CCGCCCATGCAGGAACTGTTA (SEQ ID NO: 106): mut target(-10 +10):
CCGCCCATGCGGGAACTGTTA (SEQ ID NO: 108): [Model Cell line information]: cell: CFPAC1:
cancer type: PANCREAS: PAM dist: 4: indel length: 0: CRISPR gRNA ID: GF-CCELg9-943: [crRNA
sequence]: crRNA sequence: TGTAACAGTTCCCGCATGGGCGG (SEQ ID NO: 3115):
SpgRNA: attctaatacgactcactataggTGTAACAGTTCCCGCATGGGgttttagagctagaaatagcaagttaaaataaggctagtccgtt
atcaacttgaaaaagtggcaccgagtcggtgc (SEQ ID NO: 3116): [Target gene information]: Gene ID: 7157: Symbol:
TP53: Ensembl Transcript ID: EN5T00000269305.4: GRCh: 37: Chr: 17: [Target cancer mutation
information]: mut start: 7577557: mut end: 7577557: mut class: Missense Mutation: mut type: SNP: ref seq:
A: mut seq: G: mut aa: p.C242R: mutation info source: CCLE: ref target(-10 +10):
CCGCCCATGCAGGAACTGTTA (SEQ ID NO: 106): mut target(-10 +10):
CCGCCCATGCGGGAACTGTTA (SEQ ID NO: 108): [Model Cell line information]: cell: CFPAC1:
cancer type: PANCREAS: PAM dist: 8: indel length: 0: CRISPR gRNA ID: GF-CCELg9-944: [crRNA
sequence]: crRNA sequence: CCCGCATGGGCGGCATGAACCGG (SEQ ID NO: 3117):
SpgRNA: attctaatacgactcactataggCCCGCATGGGCGGCATGAACgttttagagctagaaatagcaagttaaaataaggctagtccgt
tatcaacttgaaaaagtggcaccgagtcggtgc (SEQ ID NO: 3118): [Target gene information]: Gene ID: 7157: Symbol:
TP53: Ensembl Transcript ID: EN5T00000269305.4: GRCh: 37: Chr: 17: [Target cancer mutation
information]: mut start: 7577557: mut end: 7577557: mut class: Missense Mutation: mut type: SNP: ref seq:
A: mut seq: G: mut aa: p.C242R: mutation info source: CCLE: ref target(-10 +10):
CCGCCCATGCAGGAACTGTTA (SEQ ID NO: 106): mut target(-10 +10):
CCGCCCATGCGGGAACTGTTA (SEQ ID NO: 108): [Model Cell line information]: cell: CFPAC1:
cancer type: PANCREAS: PAM dist: 18: indel length: 0: CRISPR gRNA ID: GF-CCELg9-945: [crRNA
sequence]: crRNA sequence: ATGTGTAACAGTTCCCGCATGGG (SEQ ID NO: 3119):
SpgRNA: attctaatacgactcactataggATGTGTAACAGTTCCCGCATgttttagagctagaaatagcaagttaaaataaggctagtccgtt
atcaacttgaaaaagtggcaccgagtcggtgc (SEQ ID NO: 312 0): [Target gene information]: Gene ID: 7157: Symbol:
TP53: Ensembl Transcript ID: EN5T00000269305.4: GRCh: 37: Chr: 17: [Target cancer mutation
information]: mut start: 7577557: mut end: 7577557: mut class: Missense Mutation: mut type: SNP: ref seq:
A: mut seq: G: mut aa: p.C242R: mutation info source: CCLE: ref target(-10 +10):
CCGCCCATGCAGGAACTGTTA (SEQ ID NO: 106): mut target(-10 +10):
CCGCCCATGCGGGAACTGTTA (SEQ ID NO: 108): [Model Cell line information]: cell: CFPAC1:
cancer type: PANCREAS: PAM dist: 5: indel length: 0: CRISPR gRNA ID: GF-CCELg9-946: [crRNA
sequence]: crRNA sequence: GCGGGTGCCGGGCGGGATGTGG (SEQ ID NO: 3121):
SpgRNA: attctaatacgactcactataggGCGGGTGCCGGGCGGGATGgttttagagctagaaatagcaagttaaaataaggctagtccgt
tatcaacttgaaaaagtggcaccgagtcggtgc (SEQ ID NO: 3122): [Target gene information]: Gene ID: 7157: Symbol:
```

TABLE 7-continued

Illustrative guide RNA sequences for polypeptides comprising Cas9

TP53: Ensembl Transcript ID: ENST00000269305.4: GRCh: 37: Chr: 17: [Target cancer mutation information]: mut start: 7578479: mut end: 7578479: mut class: Missense Mutation: mut type: SNP: ref seq: G: mut seq: A: mut aa: p.P151S: mutation info source: CCLE: ref target(-10 +10): CCGGGCGGGGGTGTGGAATCA (SEQ ID NO: 3123): mut target(-10 +10): CCGGGCGGGGATGTGGAATCA (SEQ ID NO: 3124): [Model Cell line information]: cell: HPAFII: cancer type: PANCREAS: PAM dist: 3: indel length: 0: CRISPR gRNA ID: GF-CCELg9-947: [crRNA sequence]: crRNA sequence: GTTGATTCCACATCCCCGCCCGG (SEQ ID NO: 3125):
SpgRNA: attctaatacgactcactataggGTTGATTCCACATCCCCGCCCgttttagagctagaaatagcaagttaaaataaggctagtccgtt atcaacttgaaaaagtggcaccgagtcggtgc (SEQ ID NO: 3126): [Target gene information]: Gene ID: 7157: Symbol: TP53: Ensembl Transcript ID: EN5T00000269305.4: GRCh: 37: Chr: 17: [Target cancer mutation information]: mut start: 7578479: mut end: 7578479: mut class: Missense Mutation: mut type: SNP: ref seq: G: mut seq: A: mut aa: p.P151S: mutation info source: CCLE: ref target(-10 +10): CCGGGCGGGGGTGTGGAATCA (SEQ ID NO: 3123): mut target(-10 +10): CCGGGCGGGGATGTGGAATCA (SEQ ID NO: 3124): [Model Cell line information]: cell: HPAFII: cancer type: PANCREAS: PAM dist: 8: indel length: 0: CRISPR gRNA ID: GF-CCELg9-948: [crRNA sequence]: crRNA sequence: TGATGGTGAGGATGGGCCTCAGG (SEQ ID NO: 3127):
SpgRNA: attctaatacgactcactataggTGATGGTGAGGATGGGCCTCgttttagagctagaaatagcaagttaaaataaggctagtccgtt atcaacttgaaaaagtggcaccgagtcggtgc (SEQ ID NO: 3128): [Target gene information]: Gene ID: 7157: Symbol: TP53: Ensembl Transcript ID: EN5T00000269305.4: GRCh: 37: Chr: 17: [Target cancer mutation information]: mut start: 7577538: mut end: 7577538: mut class: Missense Mutation: mut type: SNP: ref seq: C: mut seq: A: mut aa: p.R248L: mutation info source: CCLE: ref target(-10 +10): GATGGGCCTCCGGTTCATGCC (SEQ ID NO: 3129): mut target(-10 +10): GATGGGCCTCAGGTTCATGCC (SEQ ID NO: 3130): [Model Cell line information]: cell: NCIH1573: cancer type: LUNG: PAM dist: 0: indel length: 0: CRISPR gRNA ID: GF-CCELg9-949: [crRNA sequence]: crRNA sequence: CAGGTTCATGCCGCCCATGCAGG (SEQ ID NO: 3131):
SpgRNA: attctaatacgactcactataggCAGGTTCATGCCGCCCATGCgttttagagctagaaatagcaagttaaaataaggctagtccgtt atcaacttgaaaaagtggcaccgagtcggtgc (SEQ ID NO: 3132): [Target gene information]: Gene ID: 7157: Symbol: TP53: Ensembl Transcript ID: EN5T00000269305.4: GRCh: 37: Chr: 17: [Target cancer mutation information]: mut start: 7577538: mut end: 7577538: mut class: Missense Mutation: mut type: SNP: ref seq: C: mut seq: A: mut aa: p.R248L: mutation info source: CCLE: ref target(-10 +10): GATGGGCCTCCGGTTCATGCC (SEQ ID NO: 3129): mut target(-10 +10): GATGGGCCTCAGGTTCATGCC (SEQ ID NO: 3130): [Model Cell line information]: cell: NCIH1573: cancer type: LUNG: PAM dist: 19: indel length: 0: CRISPR gRNA ID: GF-CCELg9-950: [crRNA sequence]: crRNA sequence: GCATGGGCGGCATGAACCTGAGG (SEQ ID NO: 3133):
SpgRNA: attctaatacgactcactataggGCATGGGCGGCATGAACCTGgttttagagctagaaatagcaagttaaaataaggctagtccgt tatcaacttgaaaaagtggcaccgagtcggtgc (SEQ ID NO: 3134): [Target gene information]: Gene ID: 7157: Symbol: TP53: Ensembl Transcript ID: EN5T00000269305.4: GRCh: 37: Chr: 17: [Target cancer mutation information]: mut start: 7577538: mut end: 7577538: mut class: Missense Mutation: mut type: SNP: ref seq: C: mut seq: A: mut aa: p.R248L: mutation info source: CCLE: ref target(-10 +10): GATGGGCCTCCGGTTCATGCC (SEQ ID NO: 3129): mut target(-10 +10): GATGGGCCTCAGGTTCATGCC (SEQ ID NO: 3130): [Model Cell line information]: cell: NCIH1573: cancer type: LUNG: PAM dist: 2: indel length: 0: CRISPR gRNA ID: GF-CCELg9-951: [crRNA sequence]: crRNA sequence: GGCATTCTGGGAGCTTAATCTGG (SEQ ID NO: 3135):
SpgRNA: attctaatacgactcactataggGGCATTCTGGGAGCTTAATCTGgttttagagctagaaatagcaagttaaaataaggctagtccgtt atcaacttgaaaaagtggcaccgagtcggtgc (SEQ ID NO: 3136): [Target gene information]: Gene ID: 7157: Symbol: TP53: Ensembl Transcript ID: EN5T00000269305.4: GRCh: 37: Chr: 17: [Target cancer mutation information]: mut start: 7579503: mut end: 7579503: mut class: Nonsense Mutation: mut type: SNP: ref seq: C: mut seq: A: mut aa: p.E62*: mutation info source: CCLE: ref target(-10 +10): CTGGGAGCTTCATCTGGACCT (SEQ ID NO: 3137): mut target(-10 +10): CTGGGAGCTTAATCTGGACCT (SEQ ID NO: 3138): [Model Cell line information]: cell: NCIH2126: cancer type: LUNG: PAM dist: 4: indel length: 0: CRISPR gRNA ID: GF-CCELg9-952: [crRNA sequence]: crRNA sequence: CTGGGAGCTTAATCTGGACCTGG (SEQ ID NO: 3139):
SpgRNA: attctaatacgactcactataggCTGGGAGCTTAATCTGGACCgttttagagctagaaatagcaagttaaaataaggctagtccgtt atcaacttgaaaaagtggcaccgagtcggtgc (SEQ ID NO: 3140): [Target gene information]: Gene ID: 7157: Symbol: TP53: Ensembl Transcript ID: EN5T00000269305.4: GRCh: 37: Chr: 17: [Target cancer mutation information]: mut start: 7579503: mut end: 7579503: mut class: Nonsense Mutation: mut type: SNP: ref seq: C: mut seq: A: mut aa: p.E62*: mutation info source: CCLE: ref target(-10 +10): CTGGGAGCTTCATCTGGACCT (SEQ ID NO: 3137): mut target(-10 +10): CTGGGAGCTTAATCTGGACCT (SEQ ID NO: 3138): [Model Cell line information]: cell: NCIH2126: cancer type: LUNG: PAM dist: 10: indel length: 0: CRISPR gRNA ID: GF-CCELg9-953: [crRNA sequence]: crRNA sequence: TGGGAGCTTAATCTGGACCTGGG (SEQ ID NO: 3141):
SpgRNA: attctaatacgactcactataggTGGGAGCTTAATCTGGACCT gttttagagctagaaatagcaagttaaaataaggctagtccgtt atcaacttgaaaaagtggcaccgagtcggtgc (SEQ ID NO: 3142): [Target gene information]: Gene ID: 7157: Symbol: TP53: Ensembl Transcript ID: EN5T00000269305.4: GRCh: 37: Chr: 17: [Target cancer mutation information]: mut start: 7579503: mut end: 7579503: mut class: Nonsense Mutation: mut type: SNP: ref seq: C: mut seq: A: mut aa: p.E62*: mutation info source: CCLE: ref target(-10 +10): CTGGGAGCTTCATCTGGACCT (SEQ ID NO: 3137): mut target(-10 +10): CTGGGAGCTTAATCTGGACCT (SEQ ID NO: 3138): [Model Cell line information]: cell: NCIH2126: cancer type: LUNG: PAM dist: 11: indel length: 0: CRISPR gRNA ID: GF-CCELg9-954: [crRNA sequence]: crRNA sequence: TTAAGCTCCCAGAATGCCAGAGG (SEQ ID NO: 3143):
SpgRNA: attctaatacgactcactataggtTAAGCTCCCAGAATGCCAGgttttagagctagaaatagcaagttaaaataaggctagtccgtt atcaacttgaaaaagtggcaccgagtcggtgc (SEQ ID NO: 3144): [Target gene information]: Gene ID: 7157: Symbol: TP53: Ensembl Transcript ID: EN5T00000269305.4: GRCh: 37: Chr: 17: [Target cancer mutation information]: mut start: 7579503: mut end: 7579503: mut class: Nonsense Mutation: mut type: SNP: ref seq: C: mut seq: A: mut aa: p.E62*: mutation info source: CCLE: ref target(-10 +10): CTGGGAGCTTCATCTGGACCT (SEQ ID NO: 3137): mut target(-10 +10):

TABLE 7-continued

Illustrative guide RNA sequences for polypeptides comprising Cas9

CTGGGAGCTTAATCTGGACCT (SEQ ID NO: 3138): [Model Cell line information]: cell: NCIH2126: cancer type: LUNG: PAM dist: 19: indel length: 0: CRISPR gRNA ID: GF-CCELg9-955: [crRNA sequence]: crRNA sequence: GGTGCCCTATGAGCCGCCTGAGG (SEQ ID NO: 3145):
SpgRNA: attctaatacgactcactataggGGTGCCCTATGAGCCGCCTGgttttagagctagaaatagcaagttaaaataaggctagtccgtt atcaacttgaaaaagtggcaccgagtcggtgc (SEQ ID NO: 3146): [Target gene information]: Gene ID: 7157: Symbol: TP53: Ensembl Transcript ID: EN5T00000269305.4: GRCh: 37: Chr: 17: [Target cancer mutation information]: mut start: 7578195: mut end: 7578197: mut class: In Frame Del: mut type: DEL: ref seq: CAC: mut seq: -: mut aa: p.V218del: mutation info source: CCLE: ref target(-10 +10): GCTCATAGGGCACCACCACACTA (SEQ ID NO: 945): mut target(-10 +10): GCTCATAGGG---CACCACACTA (SEQ ID NO: 946): [Model Cell line information]: cell: HCC827GR5: cancer type: LUNG: PAM dist: 17: indel length: 3: CRISPR gRNA ID: GF-CCELg9-956: [crRNA sequence]: crRNA sequence: GGTGCCCTATGAGCCGCCTGAGG (SEQ ID NO: 3145):
SpgRNA: attctaatacgactcactataggGGTGCCCTATGAGCCGCCTGgttttagagctagaaatagcaagttaaaataaggctagtccgtt atcaacttgaaaaagtggcaccgagtcggtgc (SEQ ID NO: 3146): [Target gene information]: Gene ID: 7157: Symbol: TP53: Ensembl Transcript ID: EN5T00000269305.4: GRCh: 37: Chr: 17: [Target cancer mutation information]: mut start: 7578195: mut end: 7578197: mut class: In Frame Del: mut type: DEL: ref seq: CAC: mut seq: -: mut aa: p.V218del: mutation info source: CCLE: ref target(-10 +10): GCTCATAGGGCACCACCACACTA (SEQ ID NO: 945): mut target(-10 +10): GCTCATAGGG---CACCACACTA (SEQ ID NO: 946): [Model Cell line information]: cell: HCC827: cancer type: LUNG: PAM dist: 17: indel length: 3: CRISPR gRNA ID: GF-CCELg9-957: [crRNA sequence]: crRNA sequence: TCCACTCGGATAAGATGCTTGAGG (SEQ ID NO: 3147):
SpgRNA: attctaatacgactcactataggTCCACTCGGATAAGATGCTGghnagagctagaaatagcaagttaaaataaggctagtccgtt atcaacttgaaaaagtggcaccgagtcggtgc (SEQ ID NO: 3148): [Target gene information]: Gene ID: 7157: Symbol: TP53: Ensembl Transcript ID: EN5T00000269305.4: GRCh: 37: Chr: 17: [Target cancer mutation information]: mut start: 7578275: mut end: 7578277: mut class: In Frame Del: mut type: DEL: ref seq: GAG: mut seq: -: mut aa: p.P191del: mutation info source: CCLE: ref target(-10 +10): ATAAGATGCTGAGGAGGGGCCAG (SEQ ID NO: 951): mut target(-10 +10): ATAAGATGCT---GAGGGGCCAG (SEQ ID NO: 952): [Model Cell line information]: cell: 5W1990: cancer type: PANCREAS: PAM dist: 2: indel length: 3: CRISPR gRNA ID: GF-CCELg9-958: [crRNA sequence]: crRNA sequence: CCACTCGGATAAGATGCTGAGGG (SEQ ID NO: 3149):
SpgRNA: attctaatacgactcactataggCCACTCGGATAAGATGCTGAgthiagagctagaaatagcaagttaaaataaggctagtccgtt atcaacttgaaaaagtggcaccgagtcggtgc (SEQ ID NO: 3150): [Target gene information]: Gene ID: 7157: Symbol: TP53: Ensembl Transcript ID: EN5T00000269305.4: GRCh: 37: Chr: 17: [Target cancer mutation information]: mut start: 7578275: mut end: 7578277: mut class: In Frame Del: mut type: DEL: ref seq: GAG: mut aa: -: mut aa: p.P191del: mutation info source: CCLE: ref target(-10 +10): ATAAGATGCTGAGGAGGGGCCAG (SEQ ID NO: 951): mut target(-10 +10): ATAAGATGCT---GAGGGGCCAG (SEQ ID NO: 952): [Model Cell line information]: cell: 5W1990: cancer type: PANCREAS: PAM dist: 3: indel length: 3: CRISPR gRNA ID: GF-CCELg9-959: [crRNA sequence]: crRNA sequence: CACTCGGATAAGATGCTTGAGGGG (SEQ ID NO: 3151):
SpgRNA: attctaatacgactcactataggCACTCGGATAAGATGCTGAGghnagagctagaaatagcaagttaaaataaggctagtccgtt atcaacttgaaaaagtggcaccgagtcggtgc (SEQ ID NO: 3152): [Target gene information]: Gene ID: 7157: Symbol: TP53: Ensembl Transcript ID: EN5T00000269305.4: GRCh: 37: Chr: 17: [Target cancer mutation information]: mut start: 7578275: mut end: 7578277: mut class: In Frame Del: mut type: DEL: ref seq: GAG: mut seq: -: mut aa: p.P191del: mutation info source: CCLE: ref target(-10 +10): ATAAGATGCTGAGGAGGGGCCAG (SEQ ID NO: 951): mut target(-10 +10): ATAAGATGCT---GAGGGGCCAG (SEQ ID NO: 952): [Model Cell line information]: cell: 5W1990: cancer type: PANCREAS: PAM dist: 4: indel length: 3: CRISPR gRNA ID: GF-CCELg9-960: [crRNA sequence]: crRNA sequence: CAGCATCTTATCCGAGTGGAAGG (SEQ ID NO: 3153):
SpgRNA: attctaatacgactcactataggCAGCATCTTATCCGAGTGGAgthiagagctagaaatagcaagttaaaataaggctagtccgtt atcaacttgaaaaagtggcaccgagtcggtgc (SEQ ID NO: 3154): [Target gene information]: Gene ID: 7157: Symbol: TP53: Ensembl Transcript ID: EN5T00000269305.4: GRCh: 37: Chr: 17: [Target cancer mutation information]: mut start: 7578275: mut end: 7578277: mut class: In Frame Del: mut type: DEL: ref seq: GAG: mut seq: -: mut aa: p.P191del: mutation info source: CCLE: ref target(-10 +10): ATAAGATGCTGAGGAGGGGCCAG (SEQ ID NO: 951): mut target(-10 +10): ATAAGATGCT---GAGGGGCCAG (SEQ ID NO: 952): [Model Cell line information]: cell: 5W1990: cancer type: PANCREAS: PAM dist: 20: indel length: 3: CRISPR gRNA ID: GF-CCELg9-961: [crRNA sequence]: crRNA sequence: CCCTCAGCATCTTATCCGAGTGG (SEQ ID NO: 3155):
SpgRNA: attctaatacgactcactataggCCCTCAGCATCTTATCCGAGgttttagagctagaaatagcaagttaaaataaggctagtccgtt atcaacttgaaaaagtggcaccgagtcggtgc (SEQ ID NO: 315 6): [Target gene information]: Gene ID: 7157: Symbol: TP53: Ensembl Transcript ID: EN5T00000269305.4: GRCh: 37: Chr: 17: [Target cancer mutation information]: mut start: 7578275: mut end: 7578277: mut class: In Frame Del: mut type: DEL: ref seq: GAG: mut seq: -: mut aa: p.P191del: mutation info source: CCLE: ref target(-10 +10): ATAAGATGCTGAGGAGGGGCCAG (SEQ ID NO: 951): mut target(-10 +10): ATAAGATGCT---GAGGGGCCAG (SEQ ID NO: 952): [Model Cell line information]: cell: 5W1990: cancer type: PANCREAS: PAM dist: 16: indel length: 3: CRISPR gRNA ID: GF-CCELg9-962: [crRNA sequence]: crRNA sequence: TGGAAAGGGGTGACTCGCTCTGG (SEQ ID NO: 3157):
SpgRNA: attctaatacgactcactataggTGGAAAGGGGTGACTCGCTCgttttagagctagaaatagcaagttaaaataaggctagtccgtt atcaacttgaaaaagtggcaccgagtcggtgc (SEQ ID NO: 315 8): [Target gene information]: Gene ID: 7186: Symbol: TRAF2: Ensembl Transcript ID: EN5T00000536468.1: GRCh: 37: Chr: 9: [Target cancer mutation informa-tion]: mut start: 139777164: mut end: 139777164: mut class: Splice Site: mut type: SNP: ref seq: T: mut seq: C: mut aa: -: mutation info source: CCLE: ref target(-10 +10): ATGGCCAGAGTGAGTCACCCC (SEQ ID NO: 955): mut target(-10 +10): ATGGCCAGAGCGAGTCACCCC (SEQ ID NO: 956): [Model Cell line information]: cell: NCIH1975: cancer type: LUNG: PAM dist: 4: indel length: 0: CRISPR gRNA ID: GF-CCELg9-963: [crRNA sequence]: crRNA sequence: GGGGTGACTCGCTCTGGCCATGG (SEQ ID NO: 3159):

TABLE 7-continued

Illustrative guide RNA sequences for polypeptides comprising Cas9

SpgRNA: attctaatacgactcactataggGGGGTGACTCGCTCTGGCCAgttttagagctagaaatagcaagttaaaataaggctagtccgtt
atcaacttgaaaaagtggcaccgagtcggtgc (SEQ ID NO: 3160): [Target gene information]: Gene ID: 7186: Symbol:
TRAF2: Ensembl Transcript ID: EN5T00000536468.1: GRCh: 37: Chr: 9: [Target cancer mutation
informa-
tion]: mut start: 139777164: mut end: 139777164: mut class: Splice Site: mut type: SNP: ref seq: T:
mut seq: C: mut aa: -: mutation info source: CCLE: ref target(-10 +10): ATGGCCAGAGTGAGTCACCCC
(SEQ ID NO: 955): mut target(-10 +10): ATGGCCAGAGCGAGTCACCCC (SEQ ID NO: 956): [Model
Cell line information]: cell: NCIH1975: cancer type: LUNG: PAM dist: 10: indel length: 0: CRISPR gRNA
ID: GF-CCELg9-964: [crRNA sequence]: crRNA sequence: GCTGGCGGCACTGCCGCTCCCGG (SEQ ID
NO: 3161):
SpgRNA: attctaatacgactcactataggGCTGGCGGCACTGCCGCTCCgttttagagctagaaatagcaagttaaaataaggctagtccgtt
atcaacttgaaaaagtggcaccgagtcggtgc (SEQ ID NO: 3162): [Target gene information]: Gene ID: 84231:
Symbol: TRAF7: Ensembl Transcript ID: EN5T00000326181.6: GRCh: 37: Chr: 16: [Target cancer mutation
information]: mut start: 2205832: mut end: 2205832: mut class: De novo Start OutOfframe: mut type: SNP:
ref seq: G: mut seq: A: mut aa: 0: mutation info source: CCLE: ref target(-10 +10):
GGCTGGCGGCGCTGCCGCTCC (SEQ ID NO: 3163): mut target(-10 +10):
GGCTGGCGGCACTGCCGCTCC (SEQ ID NO: 3164): [Model Cell line information]: cell: NCIH1573:
cancer type: LUNG: PAM dist: 11: indel length: 0: CRISPR gRNA ID: GF-CCELg9-965: [crRNA sequence]:
crRNA sequence: GCGGCACTGCCGCTCCCGGGCGG (SEQ ID NO: 3165):
SpgRNA: attctaatacgactcactataggGCGGCACTGCCGCTCCCGGGgttttagagctagaaatagcaagttaaaataaggctagtccgtt
atcaacttgaaaaagtggcaccgagtcggtgc (SEQ ID NO: 3166): [Target gene information]: Gene ID: 84231:
Symbol: TRAF7: Ensembl Transcript ID: EN5T00000326181.6: GRCh: 37: Chr: 16: [Target cancer mutation
information]: mut start: 2205832: mut end: 2205832: mut class: De novo Start OutOfframe: mut type: SNP:
ref seq: G: mut seq: A: mut aa: 0: mutation info source: CCLE: ref target(-10 +10):
GGCTGGCGGCGCTGCCGCTCC (SEQ ID NO: 3163): mut target(-10 +10):
GGCTGGCGGCACTGCCGCTCC (SEQ ID NO: 3164): [Model Cell line information]: cell: NCIH1573:
cancer type: LUNG: PAM dist: 15: indel length: 0: CRISPR gRNA ID: GF-CCELg9-966: [crRNA sequence]:
crRNA sequence: CTGGCGGCACTGCCGCTCCCGGG (SEQ ID NO: 3167):
SpgRNA: attctaatacgactcactataggCTGGCGGCACTGCCGCTCCCgttttagagctagaaatagcaagttaaaataaggctagtccgtt
atcaacttgaaaaagtggcaccgagtcggtgc (SEQ ID NO: 3168): [Target gene information]: Gene ID: 84231:
Symbol: TRAF7: Ensembl Transcript ID: EN5T00000326181.6: GRCh: 37: Chr: 16: [Target cancer mutation
information]: mut start: 2205832: mut end: 2205832: mut class: De novo Start OutOfframe: mut type: SNP:
ref seq: G: mut seq: A: mut aa: 0: mutation info source: CCLE: ref target(-10 +10):
GGCTGGCGGCGCTGCCGCTCC (SEQ ID NO: 3163): mut target(-10 +10):
GGCTGGCGGCACTGCCGCTCC (SEQ ID NO: 3164): [Model Cell line information]: cell: NCIH1573:
cancer type: LUNG: PAM dist: 12: indel length: 0: CRISPR gRNA ID: GF-CCELg9-967: [crRNA sequence]:
crRNA sequence: GGCTGGCACAGCGGTAGATGAGG (SEQ ID NO: 3169):
SpgRNA: attctaatacgactcactataggGGCTGGCACAGCGGTAGATGgttttagagctagaaatagcaagttaaaataaggctagtccgt
tatcaacttgaaaaagtggcaccgagtcggtgc (SEQ ID NO: 3170): [Target gene information]: Gene ID: 7249: Symbol:
TSC2: Ensembl Transcript ID: EN5T00000219476.3: GRCh: 37: Chr: 16: [Target cancer mutation
information]: mut start: 2124237: mut end: 2124237: mut class: Missense Mutation: mut type: SNP: ref seq:
C: mut seq: T: mut aa: p.H798Y: mutation info source: CCLE: ref target(-10 +10):
GGGCCTCATCCACCGCTGTGC (SEQ ID NO: 3171): mut target(-10 +10):
GGGCCTCATCTACCGCTGTGC (SEQ ID NO: 3172): [Model Cell line information]: cell: NCIH1975:
cancer type: LUNG: PAM dist: 5: indel length: 0: CRISPR gRNA ID: GF-CCELg9-968: [crRNA sequence]:
crRNA sequence: GGTAGATGAGGCCCTGCTCCAGG (SEQ ID NO: 3173):
SpgRNA: attctaatacgactcactataggGGTAGATGAGGCCCTGCTCCgttttagagctagaaatagcaagttaaaataaggctagtccgtt
atcaacttgaaaaagtggcaccgagtcggtgc (SEQ ID NO: 3174): [Target gene information]: Gene ID: 7249: Symbol:
TSC2: Ensembl Transcript ID: EN5T00000219476.3: GRCh: 37: Chr: 16: [Target cancer mutation
information]: mut start: 2124237: mut end: 2124237: mut class: Missense Mutation: mut type: SNP: ref seq:
C: mut seq: T: mut aa: p.H798Y: mutation info source: CCLE: ref target(-10 +10):
GGGCCTCATCCACCGCTGTGC (SEQ ID NO: 3171): mut target(-10 +10):
GGGCCTCATCTACCGCTGTGC (SEQ ID NO: 3172): [Model Cell line information]: cell: NCIH1975:
cancer type: LUNG: PAM dist: 17: indel length: 0: CRISPR gRNA ID: GF-CCELg9-969: [crRNA sequence]:
crRNA sequence: CCATAAACTTTCTGCTGTCTTGG (SEQ ID NO: 3175):
SpgRNA: attctaatacgactcactataggCCATAAACTTTCTGCTGTCTTgttttagagctagaaatagcaagttaaaataaggctagtccgtta
tcaacttgaaaaagtggcaccgagtcggtgc (SEQ ID NO: 3176): [Target gene information]: Gene ID: 7422: Symbol:
VEGFA: Ensembl Transcript ID: EN5T00000523873.1: GRCh: 37: Chr: 6: [Target cancer mutation
information]: mut start: 43738986: mut end: 43738986: mut class: Start Codon SNP: mut type: SNP: ref seq:
G: mut seq: A: mut aa: p.M1I: mutation info source: CCLE: ref target(-10 +10):
CCGAAACCATGAACTTTCTGC (SEQ ID NO: 959): mut target(-10 +10):
CCGAAACCATAAACTTTCTGC (SEQ ID NO: 960): [Model Cell line information]: cell: HCC827: cancer
type: LUNG: PAM dist: 16: indel length: 0: CRISPR gRNA ID: GF-CCELg9-970: [crRNA sequence]:
crRNA sequence: CATAAACTTTCTGCTGTCTTGGG (SEQ ID NO: 3177):
SpgRNA: attctaatacgactcactataggCATAAACTTTCTGCTGTCTTgttttagagctagaaatagcaagttaaaataaggctagtccgtta
tcaacttgaaaaagtggcaccgagtcggtgc (SEQ ID NO: 3178): [Target gene information]: Gene ID: 7422: Symbol:
VEGFA: Ensembl Transcript ID: EN5T00000523873.1: GRCh: 37: Chr: 6: [Target cancer mutation
information]: mut start: 43738986: mut end: 43738986: mut class: Start Codon SNP: mut type: SNP: ref seq:
G: mut seq: A: mut aa: p.M1I: mutation info source: CCLE: ref target(-10 +10):
CCGAAACCATGAACTTTCTGC (SEQ ID NO: 959): mut target(-10 +10):
CCGAAACCATAAACTTTCTGC (SEQ ID NO: 960): [Model Cell line information]: cell: HCC827: cancer
type: LUNG: PAM dist: 17: indel length: 0: CRISPR gRNA ID: GF-CCELg9-971: [crRNA sequence]:
crRNA sequence: CAGAAAGTTTATGGTTTCGGAGG (SEQ ID NO: 3179):
SpgRNA: attctaatacgactcactataggCAGAAAGTTTATGGTTTCGGgttttagagctagaaatagcaagttaaaataaggctagtccgtt
atcaacttgaaaaagtggcaccgagtcggtgc (SEQ ID NO: 3180): [Target gene information]: Gene ID: 7422: Symbol:
VEGFA: Ensembl Transcript ID: EN5T00000523873.1: GRCh: 37: Chr: 6: [Target cancer mutation
information]: mut start: 43738986: mut end: 43738986: mut class: Start Codon SNP: mut type: SNP: ref seq:
G: mut seq: A: mut aa: p.M1I: mutation info source: CCLE: ref target(-10 +10):

TABLE 7-continued

Illustrative guide RNA sequences for polypeptides comprising Cas9

CCGAAACCATGAACTTTCTGC (SEQ ID NO: 959): mut target(-10 +10):
CCGAAACCATAAACTTTCTGC (SEQ ID NO: 960): [Model Cell line information]: cell: HCC827: cancer
type: LUNG: PAM dist: 11: indel length: 0: CRISPR gRNA ID: GF-CCELg9-972: [crRNA sequence]:
crRNA sequence: CCAAGACAGCAGAAAGTTTATGG (SEQ ID NO: 3181):
SpgRNA: attctaatacgactcactataggCCAAGACAGCAGAAAGTTTAGttttagagctagaaatagcaagttaaaataaggctagtccgt
tatcaacttgaaaaagtggcaccgagtcggtgc (SEQ ID NO: 3182): [Target gene information]: Gene ID: 7422: Symbol:
VEGFA: Ensembl Transcript ID: EN5T00000523873.1: GRCh: 37: Chr: 6: [Target cancer mutation
information]: mut start: 43738986: mut end: 43738986: mut class: Start Codon SNP: mut type: SNP: ref seq:
G: mut seq: A: mut aa: p.M1I: mutation info source: CCLE: ref target(-10 +10):
CCGAAACCATGAACTTTCTGC (SEQ ID NO: 959): mut target(-10 +10):
CCGAAACCATAAACTTTCTGC (SEQ ID NO: 960): [Model Cell line information]: cell: HCC827: cancer
type: LUNG: PAM dist: 2: indel length: 0: CRISPR gRNA ID: GF-CCELg9-973: [crRNA sequence]: crRNA
sequence: CAGCAGAAAGTTTATGGTTTCGG (SEQ ID NO: 3183):
SpgRNA: attctaatacgactcactataggCAGCAGAAAGTTTATGGTTTgttttagagctagaaatagcaagttaaaataaggctagtccgtt
atcaacttgaaaaagtggcaccgagtcggtgc (SEQ ID NO: 3184): [Target gene information]: Gene ID: 7422: Symbol:
VEGFA: Ensembl Transcript ID: EN5T00000523873.1: GRCh: 37: Chr: 6: [Target cancer mutation
information]: mut start: 43738986: mut end: 43738986: mut class: Start Codon SNP: mut type: SNP: ref seq:
G: mut seq: A: mut aa: p.M1I: mutation info source: CCLE: ref target(-10 +10):
CCGAAACCATGAACTTTCTGC (SEQ ID NO: 959): mut target(-10 +10):
CCGAAACCATAAACTTTCTGC (SEQ ID NO: 960): [Model Cell line information]: cell: HCC827: cancer
type: LUNG: PAM dist: 8: indel length: 0: CRISPR gRNA ID: GF-CCELg9-974: [crRNA sequence]: crRNA
sequence: TATGGTTTCGGAGGCCCGACCGG (SEQ ID NO: 3185):
SpgRNA: attctaatacgactcactataggTATGGTTTCGGAGGCCCGACgttttagagctagaaatagcaagttaaaataaggctagtccgtt
atcaacttgaaaaagtggcaccgagtcggtgc (SEQ ID NO: 3186): [Target gene information]: Gene ID: 7422: Symbol:
VEGFA: Ensembl Transcript ID: EN5T00000523873.1: GRCh: 37: Chr: 6: [Target cancer mutation
information]: mut start: 43738986: mut end: 43738986: mut class: Start Codon SNP: mut type: SNP: ref seq:
G: mut seq: A: mut aa: p.M1I: mutation info source: CCLE: ref target(-10 +10):
CCGAAACCATGAACTTTCTGC (SEQ ID NO: 959): mut target(-10 +10):
CCGAAACCATAAACTTTCTGC (SEQ ID NO: 960): [Model Cell line information]: cell: HCC827: cancer
type: LUNG: PAM dist: 20: indel length: 0: CRISPR gRNA ID: GF-CCELg9-975: [crRNA sequence]:
crRNA sequence: TCAACTATGTCAGTTTGTAATGG (SEQ ID NO: 3187):
SpgRNA: attctaatacgactcactataggTCAACTATGTCAGTTTGTAA gttttagagctagaaatagcaagttaaaataaggctagtccgtt
atcaacttgaaaaagtggcaccgagtcggtgc (SEQ ID NO: 3188): [Target gene information]: Gene ID: 7514: Symbol:
XPO1: Ensembl Transcript ID: EN5T00000401558.2: GRCh: 37: Chr: 2: [Target cancer mutation
information]: mut start: 61726015: mut end: 61726015: mut class: Silent: mut type: SNP: ref seq: C: mut
seq: T: mut aa: p.L208L: mutation info source: CCLE: ref target(-10 +10):
CAAACTGACACAGTTGAAATA (SEQ ID NO: 975): mut target(-10 +10):
CAAACTGACATAGTTGAAATA (SEQ ID NO: 976): [Model Cell line information]: cell: NCIH1573:
cancer type: LUNG: PAM dist: 14: indel length: 0: CRISPR gRNA ID: GF-CCELg9-976: [crRNA sequence]:
crRNA sequence: GGAAGTCCCCATTGGCCAGCAGG (SEQ ID NO: 3189):
SpgRNA: attctaatacgactcactataggGGAAGTCCCCATTGGCCAGCgttttagagctagaaatagcaagttaaaataaggctagtccgtt
atcaacttgaaaaagtggcaccgagtcggtgc (SEQ ID NO: 3190): [Target gene information]: Gene ID: 463: Symbol:
ZFHX3: Ensembl Transcript ID: EN5T00000268489.5: GRCh: 37: Chr: 16: [Target cancer mutation
information]: mut start: 72832164: mut end: 72832164: mut class: Missense Mutation: mut type: SNP: ref
seq: G: mut seq: A: mut aa: p.L1473F: mutation info source: CCLE: ref target(-10 +10):
ATTGCCAGGAGGTCCCCATTG (SEQ ID NO: 3191): mut target(-10 +10):
ATTGCCAGGAAGTCCCCATTG (SEQ ID NO: 3192): [Model Cell line information]: cell: A549: cancer
type: LUNG: PAM dist: 17: indel length: 0: CRISPR gRNA ID: GF-CCELg9-977: [crRNA sequence]:
crRNA sequence: CATTGCCAGGAAGTCCCCATTGG (SEQ ID NO: 3193):
SpgRNA: attctaatacgactcactataggCATTGCCAGGAAGTCCCCATgttttagagctagaaatagcaagttaaaataaggctagtccgtt
atcaacttgaaaaagtggcaccgagtcggtgc (SEQ ID NO: 3194): [Target gene information]: Gene ID: 463: Symbol:
ZFHX3: Ensembl Transcript ID: EN5T00000268489.5: GRCh: 37: Chr: 16: [Target cancer mutation
information]: mut start: 72832164: mut end: 72832164: mut class: Missense Mutation: mut type: SNP: ref
seq: G: mut seq: A: mut aa: p.L1473F: mutation info source: CCLE: ref target(-10 +10):
ATTGCCAGGAGGTCCCCATTG (SEQ ID NO: 3191): mut target(-10 +10):
ATTGCCAGGAAGTCCCCATTG (SEQ ID NO: 3192): [Model Cell line information]: cell: A549: cancer
type: LUNG: PAM dist: 9: indel length: 0: CRISPR gRNA ID: GF-CCELg9-978: [crRNA sequence]: crRNA
sequence: GCTGGCCAATGGGACTTCCTGG (SEQ ID NO: 3195):
SpgRNA: attctaatacgactcactataggGCTGGCCAATGGGACTTCCgttttagagctagaaatagcaagttaaaataaggctagtccgtt
atcaacttgaaaaagtggcaccgagtcggtgc (SEQ ID NO: 3196): [Target gene information]: Gene ID: 463: Symbol:
ZFHX3: Ensembl Transcript ID: EN5T00000268489.5: GRCh: 37: Chr: 16: [Target cancer mutation
information]: mut start: 72832164: mut end: 72832164: mut class: Missense Mutation: mut type: SNP: ref
seq: G: mut seq: A: mut aa: p.L1473F: mutation info source: CCLE: ref target(-10 +10):
ATTGCCAGGAGGTCCCCATTG (SEQ ID NO: 3191): mut target(-10 +10):
ATTGCCAGGAAGTCCCCATTG (SEQ ID NO: 3192): [Model Cell line information]: cell: A549: cancer
type: LUNG: PAM dist: 4: indel length: 0: CRISPR gRNA ID: GF-CCELg9-979: [crRNA sequence]: crRNA
sequence: CAATGGGACTTCCTGGCAATGG (SEQ ID NO: 3197):
SpgRNA: attctaatacgactcactataggCAATGGGACTTCCTGGCAAgttttagagctagaaatagcaagttaaaataaggctagtccgtt
atcaacttgaaaaagtggcaccgagtcggtgc (SEQ ID NO: 3198): [Target gene information]: Gene ID: 463: Symbol:
ZFHX3: Ensembl Transcript ID: ENST00000268489.5: GRCh: 37: Chr: 16: [Target cancer mutation
information]: mut start: 72832164: mut end: 72832164: mut class: Missense Mutation: mut type: SNP: ref
seq: G: mut seq: A: mut aa: p.L1473F: mutation info source: CCLE: ref target(-10 +10):
ATTGCCAGGAGGTCCCCATTG (SEQ ID NO: 3191): mut target(-10 +10):
ATTGCCAGGAAGTCCCCATTG (SEQ ID NO: 3192): [Model Cell line information]: cell: A549: cancer
type: LUNG: PAM dist: 10: indel length: 0: CRISPR gRNA ID: GF-CCELg9-980: [crRNA sequence]:
crRNA sequence: AATGGGACTTCCTGGCAATGGG (SEQ ID NO: 3199):
SpgRNA: attctaatacgactcactataggAATGGGACTTCCTGGCAATgttttagagctagaaatagcaagttaaaataaggctagtccgtt
atcaacttgaaaaagtggcaccgagtcggtgc (SEQ ID NO: 3200): [Target gene information]: Gene ID: 463: Symbol:

TABLE 7-continued

Illustrative guide RNA sequences for polypeptides comprising Cas9

ZFHX3: Ensembl Transcript ID: EN5T00000268489.5: GRCh: 37: Chr: 16: [Target cancer mutation information]: mut start: 72832164: mut end: 72832164: mut class: Missense Mutation: mut type: SNP: ref seq: G: mut seq: A: mut aa: p.L1473F: mutation info source: CCLE: ref target(-10 +10): ATTGCCAGGAGGTCCCCATTG (SEQ ID NO: 3191): mut target(-10 +10): ATTGCCAGGAAGTCCCCATTG (SEQ ID NO: 3192): [Model Cell line information]: cell: A549: cancer type: LUNG: PAM dist: 11: indel length: 0: CRISPR gRNA ID: GF-CCELg9-981: [crRNA sequence]: crRNA sequence: TATGCTGTTGGGAAACGATATGG (SEQ ID NO: 3201): SpgRNA: attctaatacgactcactataggTATGCTGTTGGGAAACGATAgttttagagctagaaatagcaagttaaaataaggctagtccgtt atcaacttgaaaaagtggcaccgagtcggtgc (SEQ ID NO: 3202): [Target gene information]: Gene ID: 463: Symbol: ZFHX3: Ensembl Transcript ID: EN5T00000268489.5: GRCh: 37: Chr: 16: [Target cancer mutation information]: mut start: 72827451: mut end: 72827451: mut class: Missense Mutation: mut type: SNP: ref seq: A: mut seq: C: mut aa: p.F3044V: mutation info source: CCLE: ref target(-10 +10): TGTTGGGAAAAGATATGGTCA (SEQ ID NO: 979): mut target(-10 +10): TGTTGGGAAACGATATGGTCA (SEQ ID NO: 980): [Model Cell line information]: cell: NCIH1299: cancer type: LUNG: PAM dist: 5: indel length: 0: CRISPR gRNA ID: GF-CCELg9-982: [crRNA sequence]: crRNA sequence: GCCACCGCCGCCGCCGCCGCTGG (SEQ ID NO: 3203): SpgRNA: attctaatacgactcactataggGCCACCGCCGCCGCCGCCGCGttttagagctagaaatagcaagttaaaataaggctagtccgtt uean ni.D. spec. atcaacttgaaaaagtggcaccgagtcggtgc (SEQ ID NO: 3204): [Target gene information]: Gene ID: 463: Symbol: ZFHX3: Ensembl Transcript ID: ENST00000268489.5: GRCh: 37: Chr: 16: [Target cancer mutation information]: mut start: 72821658: mut end: 72821658: mut class: Missense Mutation: mut type: SNP: ref seq: G: mut seq: C: mut aa: p.T3506S: mutation info source: CCLE: ref target(-10 +10): GCCGCCGCCGGTGGGGACGTG (SEQ ID NO: 3205): mut target(-10 +10): GCCGCCGCCGCTGGGGACGTG (SEQ ID NO: 3206): [Model Cell line information]: cell: NCIH1975: cancer type: LUNG: PAM dist: 1: indel length: 0: CRISPR gRNA ID: GF-CCELg9-983: [crRNA sequence]: crRNA sequence: CCACCGCCGCCGCCGCCGCTGGG (SEQ ID NO: 3207): SpgRNA: attctaatacgactcactataggCCACCGCCGCCGCCGCCGCTgttttagagctagaaatagcaagttaaaataaggctagtccgtt atcaacttgaaaaagtggcaccgagtcggtgc (SEQ ID NO: 3208): [Target gene information]: Gene ID: 463: Symbol: ZFHX3: Ensembl Transcript ID: EN5T00000268489.5: GRCh: 37: Chr: 16: [Target cancer mutation information]: mut start: 72821658: mut end: 72821658: mut class: Missense Mutation: mut type: SNP: ref seq: G: mut seq: C: mut aa: p.T35065: mutation info source: CCLE: ref target(-10 +10): GCCGCCGCCGGTGGGGACGTG (SEQ ID NO: 3205): mut target(-10 +10): GCCGCCGCCGCTGGGGACGTG (SEQ ID NO: 3206): [Model Cell line information]: cell: NCIH1975: cancer type: LUNG: PAM dist: 2: indel length: 0: CRISPR gRNA ID: GF-CCELg9-984: [crRNA sequence]: crRNA sequence: CACCGCCGCCGCCGCCGCTGGGG (SEQ ID NO: 3209): SpgRNA: attctaatacgactcactataggCACCGCCGCCGCCGCCGCTGgttttagagctagaaatagcaagttaaaataaggctagtccgtt atcaacttgaaaaagtggcaccgagtcggtgc (SEQ ID NO: 3210): [Target gene information]: Gene ID: 463: Symbol: ZFHX3: Ensembl Transcript ID: EN5T00000268489.5: GRCh: 37: Chr: 16: [Target cancer mutation information]: mut start: 72821658: mut end: 72821658: mut class: Missense Mutation: mut type: SNP: ref seq: G: mut seq: C: mut aa: p.T35065: mutation info source: CCLE: ref target(-10 +10): GCCGCCGCCGGTGGGGACGTG (SEQ ID NO: 3205): mut target(-10 +10): GCCGCCGCCGCTGGGGACGTG (SEQ ID NO: 3206): [Model Cell line information]: cell: NCIH1975: cancer type: LUNG: PAM dist: 3: indel length: 0: CRISPR gRNA ID: GF-CCELg9-985: [crRNA sequence]: crRNA sequence: CCCAGCGGCGGCGGCGGCGGTGG (SEQ ID NO: 3211): SpgRNA: attctaatacgactcactataggCCCAGCGGCGGCGGCGGCGGttttagagctagaaatagcaagttaaaataaggctagtccgt tatcaacttgaaaaagtggcaccgagtcggtgc (SEQ ID NO: 3212): [Target gene information]: Gene ID: 463: Symbol: ZFHX3: Ensembl Transcript ID: EN5T00000268489.5: GRCh: 37: Chr: 16: [Target cancer mutation information]: mut start: 72821658: mut end: 72821658: mut class: Missense Mutation: mut type: SNP: ref seq: G: mut seq: C: mut aa: p.T35065: mutation info source: CCLE: ref target(-10 +10): GCCGCCGCCGGTGGGGACGTG (SEQ ID NO: 3205): mut target(-10 +10): GCCGCCGCCGCTGGGGACGTG (SEQ ID NO: 3206): [Model Cell line information]: cell: NCIH1975: cancer type: LUNG: PAM dist: 16: indel length: 0: CRISPR gRNA ID: GF-CCELg9-986: [crRNA sequence]: crRNA sequence: ATGGTGCTTCACGTCCCCAGCGG (SEQ ID NO: 3213): SpgRNA: attctaatacgactcactataggATGGTGCTTCACGTCCCCAGgttttagagctagaaatagcaagttaaaataaggctagtccgtt atcaacttgaaaaagtggcaccgagtcggtgc (SEQ ID NO: 3214): [Target gene information]: Gene ID: 463: Symbol: ZFHX3: Ensembl Transcript ID: ENST00000268489.5: GRCh: 37: Chr: 16: [Target cancer mutation information]: mut start: 72821658: mut end: 72821658: mut class: Missense Mutation: mut type: SNP: ref seq: G: mut seq: C: mut aa: p.T3506S: mutation info source: CCLE: ref target(-10 +10): GCCGCCGCCGGTGGGGACGTG (SEQ ID NO: 3205): mut target(-10 +10): GCCGCCGCCGCTGGGGACGTG (SEQ ID NO: 3206): [Model Cell line information]: cell: NCIH1975: cancer type: LUNG: PAM dist: 1: indel length: 0: CRISPR gRNA ID: GF-CCELg9-987: [crRNA sequence]: crRNA sequence: GTGCTTCACGTCCCCAGCGGCGG (SEQ ID NO: 3215): SpgRNA: attctaatacgactcactataggGTGCTTCACGTCCCCAGCGGgttttagagctagaaatagcaagttaaaataaggctagtccgtt atcaacttgaaaaagtggcaccgagtcggtgc (SEQ ID NO: 3216): [Target gene information]: Gene ID: 463: Symbol: ZFHX3: Ensembl Transcript ID: EN5T00000268489.5: GRCh: 37: Chr: 16: [Target cancer mutation information]: mut start: 72821658: mut end: 72821658: mut class: Missense Mutation: mut type: SNP: ref seq: G: mut seq: C: mut aa: p.T35065: mutation info source: CCLE: ref target(-10 +10): GCCGCCGCCGGTGGGGACGTG (SEQ ID NO: 3205): mut target(-10 +10): GCCGCCGCCGCTGGGGACGTG (SEQ ID NO: 3206): [Model Cell line information]: cell: NCIH1975: cancer type: LUNG: PAM dist: 4: indel length: 0: CRISPR gRNA ID: GF-CCELg9-988: [crRNA sequence]: crRNA sequence: CTTCACGTCCCCAGCGGCGGCGG (SEQ ID NO: 3217): SpgRNA: attctaatacgactcactataggCTTCACGTCCCCAGCGGCGGgttttagagctagaaatagcaagttaaaataaggctagtccgtt atcaacttgaaaaagtggcaccgagtcggtgc (SEQ ID NO: 3218): [Target gene information]: Gene ID: 463: Symbol: ZFHX3: Ensembl Transcript ID: EN5T00000268489.5: GRCh: 37: Chr: 16: [Target cancer mutation information]: mut start: 72821658: mut end: 72821658: mut class: Missense Mutation: mut type: SNP: ref seq: G: mut seq: C: mut aa: p.T35065: mutation info source: CCLE: ref target(-10 +10): GCCGCCGCCGGTGGGGACGTG (SEQ ID NO: 3205): mut target(-10 +10): GCCGCCGCCGCTGGGGACGTG (SEQ ID NO: 3206): [Model Cell line information]: cell: NCIH1975:

TABLE 7-continued

Illustrative guide RNA sequences for polypeptides comprising Cas9 cancer type: LUNG: PAM dist: 7: indel length: 0: CRISPR gRNA ID: GF-CCELg9-989: [crRNA sequence]:
crRNA sequence: CACGTCCCCA<u>G</u>CGGCGGCGGCGG (SEQ ID NO: 3219):
SpgRNA: attctaatacgactcactataggCACGTCCCCAGCGGCGGCGGCGGgttttagagctagaaatagcaagttaaaataaggctagtccgt
tatcaacttgaaaaagtggcaccgagtcggtgc (SEQ ID NO: 3220): [Target gene information]: Gene ID: 463: Symbol:
ZFHX3: Ensembl Transcript ID: ENST00000268489.5: GRCh: 37: Chr: 16: [Target cancer mutation
information]: mut start: 72821658: mut end: 72821658: mut class: Missense Mutation: mut type: SNP: ref
Clean Sub. Spec.
seq: G: mut seq: C: mut aa: p.T3506S: mutation info source: CCLE: ref target(-10 +10):
GCCGCCGCCG<u>G</u>TGGGGACGTG (SEQ ID NO: 3205): mut target(-10 +10):
GCCGCCGCCG<u>C</u>TGGGGACGTG (SEQ ID NO: 3206): [Model Cell line information]: cell: NCIH1975:
cancer type: LUNG: PAM dist: 10: indel length: 0: CRISPR gRNA ID: GF-CCELg9-990: [crRNA sequence]:
crRNA sequence: GTCCCCA<u>G</u>CGGCGGCGGCGGCGG (SEQ ID NO: 3221):
SpgRNA: attctaatacgactcactataggGTCCCCAGCGGCGGCGGCGGCGGgttttagagctagaaatagcaagttaaaataaggctagtccgt
tatcaacttgaaaaagtggcaccgagtcggtgc (SEQ ID NO: 3222): [Target gene information]: Gene ID: 463: Symbol:
ZFHX3: Ensembl Transcript ID: ENST00000268489.5: GRCh: 37: Chr: 16: [Target cancer mutation
information]: mut start: 72821658: mut end: 72821658: mut class: Missense Mutation: mut type: SNP: ref
seq: G: mut seq: C: mut aa: p.T3506S: mutation info source: CCLE: ref target(-10 +10):
GCCGCCGCCG<u>G</u>TGGGGACGTG (SEQ ID NO: 3205): mut target(-10 +10):
GCCGCCGCCG<u>C</u>TGGGGACGTG (SEQ ID NO: 3206): [Model Cell line information]: cell: NCIH1975:
cancer type: LUNG: PAM dist: 13: indel length: 0: CRISPR gRNA ID: GF-CCELg9-991: [crRNA sequence]:
crRNA sequence: GCCACCGCCGCCGCCGCCGG<u>C</u>GG (SEQ ID NO: 3223):
SpgRNA: attctaatacgactcactataggGCCACCGCCGCCGCCGCCGGgttttagagctagaaatagcaagttaaaataaggctagtccgtt
atcaacttgaaaaagtggcaccgagtcggtgc (SEQ ID NO: 3224): [Target gene information]: Gene ID: 463: Symbol:
ZFHX3: Ensembl Transcript ID: ENST00000268489.5: GRCh: 37: Chr: 16: [Target cancer mutation
information]: mut start: 72821659: mut end: 72821659: mut class: Missense Mutation: mut type: SNP: ref
seq: T: mut seq: C: mut aa: p.T3506A: mutation info source: CCLE: ref target(-10 +10):
CCGCCGCCGG<u>T</u>GGGGACGTGA (SEQ ID NO: 3225): mut target(-10 +10):
CCGCCGCCGG<u>C</u>GGGGACGTGA (SEQ ID NO: 3226): [Model Cell line information]: cell: NCIH1975:
cancer type: LUNG: PAM dist: 0: indel length: 0: CRISPR gRNA ID: GF-CCELg9-992: [crRNA sequence]:
crRNA sequence: CCACCGCCGCCGCCGCCGG<u>C</u>GGG (SEQ ID NO: 3227):
SpgRNA: attctaatacgactcactataggCCACCGCCGCCGCCGCCGGCGGGgttttagagctagaaatagcaagttaaaataaggctagtccgtt
atcaacttgaaaaagtggcaccgagtcggtgc (SEQ ID NO: 3228): [Target gene information]: Gene ID: 463: Symbol:
ZFHX3: Ensembl Transcript ID: ENST00000268489.5: GRCh: 37: Chr: 16: [Target cancer mutation
information]: mut start: 72821659: mut end: 72821659: mut class: Missense Mutation: mut type: SNP: ref
seq: T: mut seq: C: mut aa: p.T3506A: mutation info source: CCLE: ref target(-10 +10):
CCGCCGCCGG<u>T</u>GGGGACGTGA (SEQ ID NO: 3225): mut target(-10 +10):
CCGCCGCCGG<u>C</u>GGGGACGTGA (SEQ ID NO: 3226): [Model Cell line information]: cell: NCIH1975:
cancer type: LUNG: PAM dist: 1: indel length: 0: CRISPR gRNA ID: GF-CCELg9-993: [crRNA sequence]:
crRNA sequence: CACCGCCGCCGCCGCCGG<u>C</u>GGGG (SEQ ID NO: 3229):
SpgRNA: attctaatacgactcactataggCACCGCCGCCGCCGCCGGCGGGGgttttagagctagaaatagcaagttaaaataaggctagtccgt
tatcaacttgaaaaagtggcaccgagtcggtgc (SEQ ID NO: 3230): [Target gene information]: Gene ID: 463: Symbol:
ZFHX3: Ensembl Transcript ID: ENST00000268489.5: GRCh: 37: Chr: 16: [Target cancer mutation
information]: mut start: 72821659: mut end: 72821659: mut class: Missense Mutation: mut type: SNP: ref
seq: T: mut seq: C: mut aa: p.T3506A: mutation info source: CCLE: ref target(-10 +10):
CCGCCGCCGG<u>T</u>GGGGACGTGA (SEQ ID NO: 3225): mut target(-10 +10):
CCGCCGCCGG<u>C</u>GGGGACGTGA (SEQ ID NO: 3226): [Model Cell line information]: cell: NCIH1975:
cancer type: LUNG: PAM dist: 2: indel length: 0: CRISPR gRNA ID: GF-CCELg9-994: [crRNA sequence]:
crRNA sequence: CCC<u>G</u>CCGGCGGCGGCGGCGGTGG (SEQ ID NO: 3231):
SpgRNA: attctaatacgactcactataggCCCGCCGGCGGCGGCGGCGGgttttagagctagaaatagcaagttaaaataaggctagtccgt
tatcaacttgaaaaagtggcaccgagtcggtgc (SEQ ID NO: 3232): [Target gene information]: Gene ID: 463: Symbol:
ZFHX3: Ensembl Transcript ID: ENST00000268489.5: GRCh: 37: Chr: 16: [Target cancer mutation
information]: mut start: 72821659: mut end: 72821659: mut class: Missense Mutation: mut type: SNP: ref
seq: T: mut seq: C: mut aa: p.T3506A: mutation info source: CCLE: ref target(-10 +10):
CCGCCGCCGG<u>T</u>GGGGACGTGA (SEQ ID NO: 3225): mut target(-10 +10):
CCGCCGCCGG<u>C</u>GGGGACGTGA (SEQ ID NO: 3226): [Model Cell line information]: cell: NCIH1975:
cancer type: LUNG: PAM dist: 17: indel length: 0: CRISPR gRNA ID: GF-CCELg9-995: [crRNA sequence]:
crRNA sequence: ATGGTGCTTCACGTCCCC<u>G</u>C (SEQ ID NO: 3233):
SpgRNA: attctaatacgactcactataggATGGTGCTTCACGTCCCCGCgttttagagctagaaatagcaagttaaaataaggctagtccgt
tatcaacttgaaaaagtggcaccgagtcggtgc (SEQ ID NO: 3234): [Target gene information]: Gene ID: 463: Symbol:
ZFHX3: Ensembl Transcript ID: ENST00000268489.5: GRCh: 37: Chr: 16: [Target cancer mutation
information]: mut start: 72821659: mut end: 72821659: mut class: Missense Mutation: mut type: SNP: ref
seq: T: mut seq: C: mut aa: p.T3506A: mutation info source: CCLE: ref target(-10 +10):
CCGCCGCCGG<u>T</u>GGGGACGTGA (SEQ ID NO: 3225): mut target(-10 +10):
CCGCCGCCGG<u>C</u>GGGGACGTGA (SEQ ID NO: 3226): [Model Cell line information]: cell: NCIH1975:
cancer type: LUNG: PAM dist: 2: indel length: 0: CRISPR gRNA ID: GF-CCELg9-996: [crRNA sequence]:
crRNA sequence: GTGCTTCACGTCCCC<u>G</u>CCGGCGG (SEQ ID NO: 3235):
SpgRNA: attctaatacgactcactataggGTGCTTCACGTCCCCGCCGGCGGgttttagagctagaaatagcaagttaaaataaggctagtccgt
tatcaacttgaaaaagtggcaccgagtcggtgc (SEQ ID NO: 3236): [Target gene information]: Gene ID: 463: Symbol:
ZFHX3: Ensembl Transcript ID: ENST00000268489.5: GRCh: 37: Chr: 16: [Target cancer mutation
information]: mut start: 72821659: mut end: 72821659: mut class: Missense Mutation: mut type: SNP: ref
seq: T: mut seq: C: mut aa: p.T3506A: mutation info source: CCLE: ref target(-10 +10):
CCGCCGCCGG<u>T</u>GGGGACGTGA (SEQ ID NO: 3225): mut target(-10 +10):
CCGCCGCCGG<u>C</u>GGGGACGTGA (SEQ ID NO: 3226): [Model Cell line information]: cell: NCIH1975:
cancer type: LUNG: PAM dist: 5: indel length: 0: CRISPR gRNA ID: GF-CCELg9-997: [crRNA sequence]:
crRNA sequence: CTTCACGTCCCC<u>G</u>CCGGCGGCGG (SEQ ID NO: 3237):
SpgRNA: attctaatacgactcactataggCTTCACGTCCCCGCCGGCGGgttttagagctagaaatagcaagttaaaataaggctagtccgtt
atcaacttgaaaaagtggcaccgagtcggtgc (SEQ ID NO: 3238): [Target gene information]: Gene ID: 463: Symbol:
ZFHX3: Ensembl Transcript ID: ENST00000268489.5: GRCh: 37: Chr: 16: [Target cancer mutation TABLE 7-continued Illustrative guide RNA sequences for polypeptides comprising Cas9 information]: mut start: 72821659: mut end: 72821659: mut class: Missense Mutation: mut type: SNP: ref
seq: T: mut seq: C: mut aa: p.T3506A: mutation info source: CCLE: ref target(-10 +10):
CCGCCGCCGGTGGGGACGTGA (SEQ ID NO: 3225): mut target(-10 +10):
CCGCCGCCGGCGGGGACGTGA (SEQ ID NO: 3226): [Model Cell line information]: cell: NCIH1975:
cancer type: LUNG: PAM dist: 8: indel length: 0: CRISPR gRNA ID: GF-CCELg9-998: [crRNA sequence]:
crRNA sequence: CACGTCCCCGCCGGCGGCGGCGG (SEQ ID NO: 3239):
SpgRNA: attctaatacgactcactataggCACGTCCCCGCCGGCGGCGGCGGgttttagagctagaaatagcaagttaaaataaggctagtccgtt
atcaacttgaaaaagtggcaccgagtcggtgc (SEQ ID NO: 3240): [Target gene information]: Gene ID: 463: Symbol:
ZFHX3: Ensembl Transcript ID: EN5T00000268489.5: GRCh: 37: Chr: 16: [Target cancer mutation
information]: mut start: 72821659: mut end: 72821659: mut class: Missense Mutation: mut type: SNP: ref
seq: T: mut seq: C: mut aa: p.T3506A: mutation info source: CCLE: ref target(-10 +10):
CCGCCGCCGGTGGGGACGTGA (SEQ ID NO: 3225): mut target(-10 +10):
CCGCCGCCGGCGGGGACGTGA (SEQ ID NO: 3226): [Model Cell line information]: cell: NCIH1975:
cancer type: LUNG: PAM dist: 11: indel length: 0: CRISPR gRNA ID: GF-CCELg9-999: [crRNA sequence]:
crRNA sequence: GTCCCCGCCGGCGGCGGCGG (SEQ ID NO: 3241):
SpgRNA: attctaatacgactcactataggGTCCCCGCCGGCGGCGGCGGgttttagagctagaaatagcaagttaaaataaggctagtccgt
tatcaacttgaaaaagtggcaccgagtcggtgc (SEQ ID NO: 3242): [Target gene information]: Gene ID: 463: Symbol:
ZFHX3: Ensembl Transcript ID: EN5T00000268489.5: GRCh: 37: Chr: 16: [Target cancer mutation
information]: mut start: 72821659: mut end: 72821659: mut class: Missense Mutation: mut type: SNP: ref
seq: T: mut seq: C: mut aa: p.T3506A: mutation info source: CCLE: ref target(-10 +10):
CCGCCGCCGGTGGGGACGTGA (SEQ ID NO: 3225): mut target(-10 +10):
CCGCCGCCGGCGGGGACGTGA (SEQ ID NO: 3226): [Model Cell line information]: cell: NCIH1975:
cancer type: LUNG: PAM dist: 14: indel length: 0: CRISPR gRNA ID: GF-CCELg9-1000: [crRNA
sequence]: crRNA sequence: TCGCCTGTCCGTCGGACTTTTGG (SEQ ID NO: 3243):
SpgRNA: attctaatacgactcactataggTCGCCTGTCCGTCGGACTTTgttttagagctagaaatagcaagttaaaataaggctagtccgtta
tcaacttgaaaaagtggcaccgagtcggtgc (SEQ ID NO: 3244): [Target gene information]: Gene ID: 463: Symbol:
ZFHX3: Ensembl Transcript ID: EN5T00000268489.5: GRCh: 37: Chr: 16: [Target cancer mutation
information]: mut start: 72821151: mut end: 72821151: mut class: Missense Mutation: mut type: SNP: ref
seq: G: mut seq: T: mut aa: p.P3675Q: mutation info source: CCLE: ref target(-10 +10):
CGGGCTCGCCGGTCCGTCGGA (SEQ ID NO: 983): mut target(-10 +10):
CGGGCTCGCCTGTCCGTCGGA (SEQ ID NO: 984): [Model Cell line information]: cell: NCIH460:
cancer type: LUNG: PAM dist: 15: indel length: 0: CRISPR gRNA ID: GF-CCELg9-1001: [crRNA
sequence]: crRNA sequence: CACCGGGCTCGCCTGTCCGTCGG (SEQ ID NO: 3245):
SpgRNA: attctaatacgactcactataggCACCGGGCTCGCCTGTCCGTgttttagagctagaaatagcaagttaaaataaggctagtccgtt
atcaacttgaaaaagtggcaccgagtcggtgc (SEQ ID NO: 3246): [Target gene information]: Gene ID: 463: Symbol:
ZFHX3: Ensembl Transcript ID: ENST00000268489.5: GRCh: 37: Chr: 16: [Target cancer mutation
information]: mut start: 72821151: mut end: 72821151: mut class: Missense Mutation: mut type: SNP: ref
seq: G: mut seq: T: mut aa: p.P3675Q: mutation info source: CCLE: ref target(-10 +10):
CGGGCTCGCCGGTCCGTCGGA (SEQ ID NO: 983): mut target(-10 +10):
CGGGCTCGCCTGTCCGTCGGA (SEQ ID NO: 984): [Model Cell line information]: cell: NCIH460:
cancer type: LUNG: PAM dist: 7: indel length: 0: CRISPR gRNA ID: GF-CCELg9-1002: [crRNA sequence]:
crRNA sequence: CAGCCAAAAGTCCGACGGACAGG (SEQ ID NO: 3247):
SpgRNA: attctaatacgactcactataggCAGCCAAAAGTCCGACGGACgttttagagctagaaatagcaagttaaaataaggctagtccgt
tatcaacttgaaaaagtggcaccgagtcggtgc (SEQ ID NO: 3248): [Target gene information]: Gene ID: 463: Symbol:
ZFHX3: Ensembl Transcript ID: EN5T00000268489.5: GRCh: 37: Chr: 16: [Target cancer mutation
information]: mut start: 72821151: mut end: 72821151: mut class: Missense Mutation: mut type: SNP: ref
seq: G: mut seq: T: mut aa: p.P3675Q: mutation info source: CCLE: ref target(-10 +10):
CGGGCTCGCCGGTCCGTCGGA (SEQ ID NO: 983): mut target(-10 +10):
CGGGCTCGCCTGTCCGTCGGA (SEQ ID NO: 984): [Model Cell line information]: cell: NCIH460:
cancer type: LUNG: PAM dist: 0: indel length: 0: CRISPR gRNA ID: GF-CCELg9-1003: [crRNA sequence]:
crRNA sequence: CGGACAGGCGAGCCCGGTGGAGG (SEQ ID NO: 3249):
SpgRNA: attctaatacgactcactataggCGGACAGGCGAGCCCGGTGGAGGgttttagagctagaaatagcaagttaaaataaggctagtccgt
tatcaacttgaaaaagtggcaccgagtcggtgc (SEQ ID NO: 3250): [Target gene information]: Gene ID: 463: Symbol:
ZFHX3: Ensembl Transcript ID: EN5T00000268489.5: GRCh: 37: Chr: 16: [Target cancer mutation
information]: mut start: 72821151: mut end: 72821151: mut class: Missense Mutation: mut type: SNP: ref
seq: G: mut seq: T: mut aa: p.P3675Q: mutation info source: CCLE: ref target(-10 +10):
CGGGCTCGCCGGTCCGTCGGA (SEQ ID NO: 983): mut target(-10 +10):
CGGGCTCGCCTGTCCGTCGGA (SEQ ID NO: 984): [Model Cell line information]: cell: NCIH460:
cancer type: LUNG: PAM dist: 15: indel length: 0: CRISPR gRNA ID: GF-CCELg9-1004: [crRNA
sequence]: crRNA sequence: CGACGGACAGGCGAGCCCGGTGG (SEQ ID NO: 3251):
SpgRNA: attctaatacgactcactataggCGACGGACAGGCGAGCCCGGTGGgttttagagctagaaatagcaagttaaaataaggctagtccgt
tatcaacttgaaaaagtggcaccgagtcggtgc (SEQ ID NO: 3252): [Target gene information]: Gene ID: 463: Symbol:
ZFHX3: Ensembl Transcript ID: EN5T00000268489.5: GRCh: 37: Chr: 16: [Target cancer mutation
information]: mut start: 72821151: mut end: 72821151: mut class: Missense Mutation: mut type: SNP: ref
seq: G: mut seq: T: mut aa: p.P3675Q: mutation info source: CCLE: ref target(-10 +10):
CGGGCTCGCCGGTCCGTCGGA (SEQ ID NO: 983): mut target(-10 +10):
CGGGCTCGCCTGTCCGTCGGA (SEQ ID NO: 984): [Model Cell line information]: cell: NCIH460:
cancer type: LUNG: PAM dist: 12: indel length: 0: CRISPR gRNA ID: GF-CCELg9-1005: [crRNA
sequence]: crRNA sequence: GTCCGACGGACAGGCGAGCCCG (SEQ ID NO: 3253):
SpgRNA: attctaatacgactcactataggGTCCGACGGACAGGCGAGCCgttttagagctagaaatagcaagttaaaataaggctagtccgt
tatcaacttgaaaaagtggcaccgagtcggtgc (SEQ ID NO: 3254): [Target gene information]: Gene ID: 463: Symbol:
ZFHX3: Ensembl Transcript ID: EN5T00000268489.5: GRCh: 37: Chr: 16: [Target cancer mutation
information]: mut start: 72821151: mut end: 72821151: mut class: Missense Mutation: mut type: SNP: ref
seq: G: mut seq: T: mut aa: p.P3675Q: mutation info source: CCLE: ref target(-10 +10):
CGGGCTCGCCGGTCCGTCGGA (SEQ ID NO: 983): mut target(-10 +10):
CGGGCTCGCCTGTCCGTCGGA (SEQ ID NO: 984): [Model Cell line information]: cell: NCIH460:
cancer type: LUNG: PAM dist: 9: indel length: 0: CRISPR gRNA ID: GF-CCELg9-1006: [crRNA sequence]:
crRNA sequence: GGACAGGCGAGCCCGGTGGAGGG (SEQ ID NO: 3255):

TABLE 7-continued

Illustrative guide RNA sequences for polypeptides comprising Cas9

SpgRNA: attctaatacgactcactataggGGACAGGCGGAGCCCGGTGGAgttttagagctagaaatagcaagttaaaataaggctagtccgt
tatcaacttgaaaaagtggcaccgagtcggtgc (SEQ ID NO: 3256): [Target gene information]: Gene ID: 463: Symbol:
ZFHX3: Ensembl Transcript ID: EN5T00000268489.5: GRCh: 37: Chr: 16: [Target cancer mutation
information]: mut start: 72821151: mut end: 72821151: mut class: Missense Mutation: mut type: SNP: ref
seq: G: mut seq: T: mut aa: p.P3675Q: mutation info source: CCLE: ref target(-10 +10):
CGGGCTCGCCGGTCCGTCGGA (SEQ ID NO: 983): mut target(-10 +10):
CGGGCTCGCCTGTCCGTCGGA (SEQ ID NO: 984): [Model Cell line information]: cell: NCIH460:
cancer type: LUNG: PAM dist: 16: indel length: 0: CRISPR gRNA ID: GF-CCELg9-1007: [crRNA
sequence]: crRNA sequence: GCCACCGCCGCCGCCGCCGCCGG (SEQ ID NO: 3257):
SpgRNA: attctaatacgactcactataggGCCACCGCCGCCGCCGCCGCg agagctagaaatagcaagttaaaataaggctagtccgtt
atcaacttgaaaaagtggcaccgagtcggtgc (SEQ ID NO: 3204): [Target gene information]: Gene ID: 463: Symbol:
ZFHX3: Ensembl Transcript ID: EN5T00000268489.5: GRCh: 37: Chr: 16: [Target cancer mutation
information]: mut start: 72821658: mut end: 72821659: mut class: Missense Mutation: mut type: DNP: ref
seq: GT: mut seq: CC: mut aa: p.T3506G: mutation info source: CCLE: ref target(-10 +10):
GCCGCCGCCGTGGGGACGTGA (SEQ ID NO: 3258): mut target(-10 +10):
GCCGCCGCCCCGGGGACGTGA (SEQ ID NO: 3259): [Model Cell line information]: cell: NCIH1975:
cancer type: LUNG: PAM dist: 0: indel length: 0: CRISPR gRNA ID: GF-CCELg9-1008: [crRNA sequence]:
crRNA sequence: CCACCGCCGCCGCCGCCGCCGGG (SEQ ID NO: 3260):
SpgRNA: attctaatacgactcactataggCCACCGCCGCCGCCGCCGCCGtttagagctagaaatagcaagttaaaataaggctagtccgtt
atcaacttgaaaaagtggcaccgagtcggtgc (SEQ ID NO: 3261): [Target gene information]: Gene ID: 463: Symbol:
ZFHX3: Ensembl Transcript ID: ENST00000268489.5: GRCh: 37: Chr: 16: [Target cancer mutation
information]: mut start: 72821658: mut end: 72821659: mut class: Missense Mutation: mut type: DNP: ref
seq: GT: mut seq: CC: mut aa: p.T3506G: mutation info source: CCLE: ref target(-10 +10):
GCCGCCGCCGTGGGGACGTGA (SEQ ID NO: 3258): mut target(-10 +10):
GCCGCCGCCCCGGGGACGTGA (SEQ ID NO: 3259): [Model Cell line information]: cell: NCIH1975:
cancer type: LUNG: PAM dist: 1: indel length: 0: CRISPR gRNA ID: GF-CCELg9-1009: [crRNA sequence]:
crRNA sequence: CACCGCCGCCGCCGCCGCCGGGG (SEQ ID NO: 3262):
SpgRNA: attctaatacgactcactataggCACCGCCGCCGCCGCCGCCGgttttagagctagaaatagcaagttaaaataaggctagtccgtt
atcaacttgaaaaagtggcaccgagtcggtgc (SEQ ID NO: 3263): [Target gene information]: Gene ID: 463: Symbol:
ZFHX3: Ensembl Transcript ID: EN5T00000268489.5: GRCh: 37: Chr: 16: [Target cancer mutation
information]: mut start: 72821658: mut end: 72821659: mut class: Missense Mutation: mut type: DNP: ref
seq: GT: mut seq: CC: mut aa: p.T3506G: mutation info source: CCLE: ref target(-10 +10):
GCCGCCGCCGTGGGGACGTGA (SEQ ID NO: 3258): mut target(-10 +10):
GCCGCCGCCCCGGGGACGTGA (SEQ ID NO: 3259): [Model Cell line information]: cell: NCIH1975:
cancer type: LUNG: PAM dist: 2: indel length: 0: CRISPR gRNA ID: GF-CCELg9-1010: [crRNA sequence]:
crRNA sequence: CCCGGCGGCGGCGGCGGCGGTGG (SEQ ID NO: 3264):
SpgRNA: attctaatacgactcactataggCCCGGCGGCGGCGGCGGCGGgttttagagctagaaatagcaagttaaaataaggctagtccgt
tatcaacttgaaaaagtggcaccgagtcggtgc (SEQ ID NO: 3265): [Target gene information]: Gene ID: 463: Symbol:
ZFHX3: Ensembl Transcript ID: EN5T00000268489.5: GRCh: 37: Chr: 16: [Target cancer mutation
information]: mut start: 72821658: mut end: 72821659: mut class: Missense Mutation: mut type: DNP: ref
seq: GT: mut seq: CC: mut aa: p.T3506G: mutation info source: CCLE: ref target(-10 +10):
GCCGCCGCCGTGGGGACGTGA (SEQ ID NO: 3258): mut target(-10 +10):
GCCGCCGCCCCGGGGACGTGA (SEQ ID NO: 3259): [Model Cell line information]: cell: NCIH1975:
cancer type: LUNG: PAM dist: 16: indel length: 0: CRISPR gRNA ID: GF-CCELg9-1011: [crRNA
sequence]: crRNA sequence: ATGGTGCTTCACGTCCCCGGCGG (SEQ ID NO: 3266):
SpgRNA: attctaatacgactcactataggATGGTGCTTCACGTCCCCGGg agagctagaaatagcaagttaaaataaggctagtccgtt
atcaacttgaaaaagtggcaccgagtcggtgc (SEQ ID NO: 3267): [Target gene information]: Gene ID: 463: Symbol:
ZFHX3: Ensembl Transcript ID: EN5T00000268489.5: GRCh: 37: Chr: 16: [Target cancer mutation
information]: mut start: 72821658: mut end: 72821659: mut class: Missense Mutation: mut type: DNP: ref
seq: GT: mut seq: CC: mut aa: p.T3506G: mutation info source: CCLE: ref target(-10 +10):
GCCGCCGCCGTGGGGACGTGA (SEQ ID NO: 3258): mut target(-10 +10):
GCCGCCGCCCCGGGGACGTGA (SEQ ID NO: 3259): [Model Cell line information]: cell: NC1H1975:
cancer type: LUNG: PAM dist: 1: indel length: 0: CRISPR gRNA ID: GF-CCELg9-1012: [crRNA sequence]::
crRNA sequence: GTGCTTCACGTCCCCGGCGGCGG (SEQ ID NO: 3268):
SpgRNA: attctaatacgactcactataggGTGCTTCACGTCCCCGGCGGgttttagagctagaaatagcaagttaaaataaggctagtccgtt
atcaacttgaaaaagtggcaccgagtcggtgc (SEQ ID NO: 3269): [Target gene information]: Gene ID: 463: Symbol:
ZFHX3: Ensembl Transcript ID: ENST00000268489.5: GRCh: 37: Chr: 16: [Target cancer mutation
information]: mut start: 72821658: mut end: 72821659: mut class: Missense Mutation: mut type: DNP: ref
seq: GT: mut seq: CC: mut aa: p.T3506G: mutation info source: CCLE: ref target(-10 +10):
GCCGCCGCCGTGGGGACGTGA (SEQ ID NO: 3258): mut target(-10 +10):
GCCGCCGCCCCGGGGACGTGA (SEQ ID NO: 3259): [Model Cell line information]: cell: NC1H1975:
cancer type: LUNG: PAM dist: 4: indel length: 0: CRISPR gRNA ID: GF-CCELg9-1013: [crRNA sequence]:
crRNA sequence: CTTCACGTCCCCGGCGGCGGCGG (SEQ ID NO: 3270):
SpgRNA: attctaatacgactcactataggCTTCACGTCCCCGGCGGCGGgttttagagctagaaatagcaagttaaaataaggctagtccgtt
atcaacttgaaaaagtggcaccgagtcggtgc (SEQ ID NO: 3271): [Target gene information]: Gene ID: 463: Symbol:
ZFHX3: Ensembl Transcript ID: EN5T00000268489.5: GRCh: 37: Chr: 16: [Target cancer mutation
information]: mut start: 72821658: mut end: 72821659: mut class: Missense Mutation: mut type: DNP: ref
seq: GT: mut seq: CC: mut aa: p.T3506G: mutation info source: CCLE: ref target(-10 +10):
GCCGCCGCCGTGGGGACGTGA (SEQ ID NO: 3258): mut target(-10 +10):
GCCGCCGCCCCGGGGACGTGA (SEQ ID NO: 3259): [Model Cell line information]: cell: NC1H1975:
cancer type: LUNG: PAM dist: 7: indel length: 0: CRISPR gRNA ID: GF-CCELg9-1014: [crRNA sequence]:
crRNA sequence: CACGTCCCCGGCGGCGGCGGCGG (SEQ ID NO: 3272):

TABLE 7-continued

Illustrative guide RNA sequences for polypeptides comprising Cas9

```
SpgRNA: attctaatacgactcactataggCACGTCCCCGGCGGCGGCGGgttttagagctagaaatagcaagttaaaataaggctagtccgt
tatcaacttgaaaaagtggcaccgagtcggtgc (SEQ ID NO: 3273): [Target gene information]: Gene ID: 463: Symbol:
ZFHX3: Ensembl Transcript ID: EN5T00000268489.5: GRCh: 37: Chr: 16: [Target cancer mutation
information]: mut start: 72821658: mut end: 72821659: mut class: Missense Mutation: mut type: DNP: ref
seq: GT: mut seq: CC: mut aa: p.T3506G: mutation info source: CCLE: ref target(-10 +10):
GCCGCCGCCGGTGGGGACGTGA (SEQ ID NO: 3258): mut target(-10 +10):
GCCGCCGCCGCCGGGGACGTGA (SEQ ID NO: 3259): [Model Cell line information]: cell: NC1H1975:
cancer type: LUNG: PAM dist: 10: indel length: 0: CRISPR gRNA ID: GF-CCELg9-1015: [crRNA
sequence]: crRNA sequence: GTCCCCGGCGGCGGCGGCGGCGG (SEQ ID NO: 3274):
SpgRNA: attctaatacgactcactataggGTCCCCGGCGGCGGCGGCGGgttttagagctagaaatagcaagttaaaataaggctagtccgt
tatcaacttgaaaaagtggcaccgagtcggtgc (SEQ ID NO: 3275): [Target gene information]: Gene ID: 463: Symbol:
ZFHX3: Ensembl Transcript ID: ENST00000268489.5: GRCh: 37: Chr: 16: [Target cancer mutation
information]: mut start: 72821658: mut end: 72821659: mut class: Missense Mutation: mut type: DNP: ref
seq: GT: mut seq: CC: mut aa: p.T3506G: mutation info source: CCLE: ref target(-10 +10):
GCCGCCGCCGGTGGGGACGTGA (SEQ ID NO: 3258): mut target(-10 +10):
GCCGCCGCCGCCGGGGACGTGA (SEQ ID NO: 3259): [Model Cell line information]: cell: NCIH1975:
cancer type: LUNG: PAM dist: 13: indel length: 0: CRISPR gRNA ID: GF-CCELg9-1016: [crRNA
sequence]: crRNA sequence: AGCCTGCGGACAGCCCCATCAGG (SEQ ID NO: 3276):
SpgRNA: attctaatacgactcactataggAGCCTGCGGACAGCCCCATCAGGgttttagagctagaaatagcaagttaaaataaggctagtccgtt
atcaacttgaaaaagtggcaccgagtcggtgc (SEQ ID NO: 3277): [Target gene information]: Gene ID: 463: Symbol:
ZFHX3: Ensembl Transcript ID: EN5T00000268489.5: GRCh: 37: Chr: 16: [Target cancer mutation
information]: mut start: 72822106: mut end: 72822106: mut class: Missense Mutation: mut type: SNP: ref
seq: G: mut seq: C: mut aa: p.P3357A: mutation info source: CCLE: ref target(-10 +10):
AGGGAGCCTGGGGACAGCCCC (SEQ ID NO: 3278): mut target(-10 +10):
AGGGAGCCTGCGGACAGCCCC (SEQ ID NO: 3279): [Model Cell line information]: cell: NCIH1650:
cancer type: LUNG: PAM dist: 14: indel length: 0: CRISPR gRNA ID: GF-CCELg9-1017: [crRNA
sequence]: crRNA sequence: CTGCTGCAGTAGGGAGCCTGCGG (SEQ ID NO: 3280):
SpgRNA: attctaatacgactcactataggCTGCTGCAGTAGGGAGCCTGgttttagagctagaaatagcaagttaaaataaggctagtccgtt
atcaacttgaaaaagtggcaccgagtcggtgc (SEQ ID NO: 3281): [Target gene information]: Gene ID: 463: Symbol:
ZFHX3: Ensembl Transcript ID: EN5T00000268489.5: GRCh: 37: Chr: 16: [Target cancer mutation
information]: mut start: 72822106: mut end: 72822106: mut class: Missense Mutation: mut type: SNP: ref
seq: G: mut seq: C: mut aa: p.P3357A: mutation info source: CCLE: ref target(-10 +10):
AGGGAGCCTGGGGACAGCCCC (SEQ ID NO: 3278): mut target(-10 +10):
AGGGAGCCTGCGGACAGCCCC (SEQ ID NO: 3279): [Model Cell line information]: cell: NCIH1650:
cancer type: LUNG: PAM dist: 0: indel length: 0: CRISPR gRNA ID: GF-CCELg9-1018: [crRNA sequence]:
crRNA sequence: GCCTGCGGACAGCCCCATCAGGG (SEQ ID NO: 3282):
SpgRNA: attctaatacgactcactataggGCCTGCGGACAGCCCCATCAgttttagagctagaaatagcaagttaaaataaggctagtccgtt
atcaacttgaaaaagtggcaccgagtcggtgc (SEQ ID NO: 3283): [Target gene information]: Gene ID: 463: Symbol:
ZFHX3: Ensembl Transcript ID: EN5T00000268489.5: GRCh: 37: Chr: 16: [Target cancer mutation
information]: mut start: 72822106: mut end: 72822106: mut class: Missense Mutation: mut type: SNP: ref
seq: G: mut seq: C: mut aa: p.P3357A: mutation info source: CCLE: ref target(-10 +10):
AGGGAGCCTGGGGACAGCCCC (SEQ ID NO: 3278): mut target(-10 +10):
AGGGAGCCTGCGGACAGCCCC (SEQ ID NO: 3279): [Model Cell line information]: cell: NCIH1650:
cancer type: LUNG: PAM dist: 15: indel length: 0: CRISPR gRNA ID: GF-CCELg9-1019: [crRNA
sequence]: crRNA sequence: GCCCTGATGGGGCTGTCCGCAGG (SEQ ID NO: 3284):
SpgRNA: attctaatacgactcactataggGCCCTGATGGGGCTGTCCGCgttttagagctagaaatagcaagttaaaataaggctagtccgtt
atcaacttgaaaaagtggcaccgagtcggtgc (SEQ ID NO: 3285): [Target gene information]: Gene ID: 463: Symbol:
ZFHX3: Ensembl Transcript ID: ENST00000268489.5: GRCh: 37: Chr: 16: [Target cancer mutation
information]: mut start: 72822106: mut end: 72822106: mut class: Missense Mutation: mut type: SNP: ref
seq: G: mut seq: C: mut aa: p.P3357A: mutation info source: CCLE: ref target(-10 +10):
AGGGAGCCTGGGGACAGCCCC (SEQ ID NO: 3278): mut target(-10 +10):
AGGGAGCCTGCGGACAGCCCC (SEQ ID NO: 3279): [Model Cell line information]: cell: NCIH1650:
cancer type: LUNG: PAM dist: 2: indel length: 0::
```

Example 12. In Vivo Cell Targeting for Lung Cancer

An individual is identified as suffering from lung cancer. Sequence information associated with the individual's lung cancer cells is determined and mutations corresponding with the lung cancer are identified.

A guide RNA comprising a sequence from Table 6 and paragraph [00303] is then synthesized and is assembled into a ribonucleoprotein complex with a polypeptide comprising Cas12a nuclease domain. Alternatively, or in combination, a guide RNA comprising a sequence from Table 7 and paragraph [00305] is synthesized and is assembled into a ribonucleoprotein complex with a polypeptide comprising a Cas9 nuclease domain. The complex, comprising Cas12a, Cas9, or both, are then administered to the individual and symptom amelioration and tumor size reduction is observed.

Example 12. In Vivo Cell Targeting for Pancreatic Cancer

An individual is identified as suffering from pancreatic cancer. Sequence information associated with the individual's cancer cells is determined and mutations corresponding with the cancer are identified.

A guide RNA comprising a sequence from Table 6 and paragraph [00303] is then synthesized and is assembled into a ribonucleoprotein complex with a polypeptide comprising Cas12a nuclease domain. Alternatively, or in combination, a guide RNA comprising a sequence from Table 7 and paragraph [00305] is synthesized and is assembled into a ribonucleoprotein complex with a polypeptide comprising a Cas9 nuclease domain. The complex, comprising Cas12a, Cas9, or both, are then administered to the individual and symptom amelioration and tumor size reduction is observed.

Example 13. Small Molecule Combination Therapy

The individual of any of the Examples herein is additionally administered a small molecule inhibitor of DNA double strand break repair to enhance genome editing efficiency. The inhibitor can target a gene involved in double strand break repair, for example, associated with BRCA pathway or BRCA gene. Upon administration, symptom amelioration and disease remission is observed in the individual.

Example 14. Macromolecule Combination Therapy

The individual of any of the Examples herein is additionally administered a macromolecular inhibitor of DNA double strand break repair to enhance genome editing efficiency. A guide RNA is designed to target a gene involved in double strand break repair, for example, associated with BRCA pathway or BRCA gene. The guide RNA is administered to the individual along with a Cas nuclease such as Cas9 or Cas12a. Symptom amelioration and lung cancer remission is observed in the individual upon administration of the combination therapy.

Example 15. Treatment of Adenocarcinoma with PX459 Plasmid DNA

A Cas9 expression vector (PX459, Addgene plasmid #62988) with mutant specific guide RNA was used to induce multi-cleavage in EGFR mutant lung cancer genome. HCC827, a lung adenocarcinoma cell line, was electroporated for the delivery of the Cas9/sgRNA expression vector. HCC827 has E2 mutation in its EGFR gene and there are more than 18 copies of the mutation sequence in the specific genome. The guide RNA was designed so that it targets more than 18 loci in the HCC827 cell line. Cells were grown in 75T flask using RPMI-1640 (10% fetal bovine serum) until they fill up around 50% of the area, trypsinized, washed with PBS, and resuspended in Neon Electroporation Buffer R. 150,000 cells with 500 ng of the Cas9/sgRNA expression were loaded in a 10 μL Neon Pipette tip, and electroporated under optimized conditions (1300V, 20 ms, 2 pulses). Cells were recovered in the growth media for six days and counted. FIG. 6 shows Cas9 guide RNA derived multi-cleavage induction and cell death in an EGFR mutant lung cancer cell line, HCC827, six days after neon electroporation of PX459 plasmid DNA targeting CNV. Compared to the control groups that were electroporated without any vectors or with vectors that target the wild-type EGFR sequence, the experimental group electroporated with vectors that target the HCC827 specific mutation had a significantly lower number of cells. The results additionally showed that the experimental group (EGFR E2) showed 83% cell death. The results showed that multi-cleavage induction in adenocarcinoma by Cas9 and target specific guide RNA reduced cell proliferation.

Example 16. H1299 Transfection without Drug Treatment

H1299 cells were plated at $1.5 \times 10^5$ cells per well in a 24-well plate, and 500 ng of plasmids were introduced into each wells as described above in TABLE 8 below.

TABLE 8

|  | NT1 | CCR5 | HPRT1 | MT2 | SMIM11 | GNPDA2 | SLC15A5 | KCNE2 |
| --- | --- | --- | --- | --- | --- | --- | --- | --- |
| Cut number | 0 | 2 | 2 | >100 | >40 | >12 | >12 | >40 |
| essentiality | N/A | Non essential | House keeping | Non essential | Non essential | oncogene | oncogene | Non essential |

Transfection was performed 24 hours after from cell plating, by using Lipofectamine3000 reagent according to the protocol served by manufacturer. 72 hours post-transfection, all supernatant was discarded by suction, and cells were washed gently with 500 μL of 1×PBS. Cells were harvested by trypsinization, and the live cell number was counted with trypan blue dye and cell countess. CCR5, HPRT1, the targets only making two cuts in the whole genome, and NT1, having no matched sequence in the human genome, showed similar cell viability. In contrast, MT2, known to make multiple cuts at more than 100 loci, showed about 50% cell viability relative to NT1. H1299 cell line specifically amplified loci, SMIM11, GNPDA2, SLC15A5, and KCNE2, showed similar cell viability as MT2, while SMIM11 and KCNE2 showed higher induction of cell death, having about 25% of cell viability relative to NT1.

Example 17. H1299 Transfection without Drug Treatment-2

H1299 cells were plated as $1.5 \times 10^5$ cells per well in a 24-well plate, and 500 ng of plasmids were introduced into each wells as described below in TABLE 9.

TABLE 9

|  | Lipo only | NT1 | CCR5 | HPRT1 | MT2 | SMIM11 | GNPDA2 | SLC15A5 | KCNE2 |
| --- | --- | --- | --- | --- | --- | --- | --- | --- | --- |
| cut number | N/A | 0 | 2 | 2 | >100 | >40 | >12 | >12 | >40 |
| essentiality | N/A | N/A | Non-essential | House-keeping | Non-essential | Non-essential | oncogene | oncogene | Non-essential |

Transfection was performed at 24 hours after cell plating, by using Lipofectamine3000 reagent according to the protocol served by manufacturer. 48 hours post-transfection, all supernatant was discarded by suction, and cells were washed gently with 500 µL of 1×PBS. Cells were harvested by trypsinization, and live cell number was counted with trypan blue dye and cell countess. CCR5, targets making two cuts in whole genome, showed 80% cell viability relative to lipofection only control. HPRT1, making two cuts in a house keeping gene, showed more toxicity with about 50% cells alive. NT1, having no matched sequence in the human genome, showed 57% cell viability compared with the lipofection only. Whereas, MT2, having multiple cut sites at more than 100 loci, showed about 14% cell viability relative to lipofection only control. The H1299 cell line specifically amplified locus targets, GNPDA2, SLC15A5, KCNE2, showed total cell death that was not reliably counted, while showed 57% cell viability compared with lipofection only. Two samples (NT1, GNPDA2) were also imaged by using a NucBlue live cell stain reagent (Blue, staining live and dead cells) and Propidium iodide dead cell stain reagent (Red, only staining the dead cells), that showed consistent result in FIG. 10.

Example 18—H1563 Transfection

H1563 cells were plated at $1.5 \times 10^5$ cells per well in a 24-well plate, and 500 ng of plasmids were introduced into each wells as described below in TABLE 10.

TABLE 10

|  | CCR5 | HPRT1 | MT2 | IRX1 | ADAMTS16 |
| --- | --- | --- | --- | --- | --- |
| cut number | 2 | 2 | >100 | >8 | >7 |
| essentiality | Non essential | House keeping | Non essential | Non essential | Non essential |

Transfection was performed 24 hours after cell plating, by using Lipofectamine3000 reagent according to the protocol served by manufacturer. 24 hours post-transfection, cells were treated with 1 µg/mL of puromycin and cells were selected for 72 hours. All supernatant was discarded by suction, and cells were washed gently by 500 µL of 1×PBS. Cells were harvested by trypsinization, and live cell number was counted with trypan blue dye and cell countess. CCR5, a target with two cuts in the whole genome, showed the highest cell viability and HPRT1 showed 52% of it. Targets making multiple cuts (MT2, IRX1, and ADAMTS16) showed similar cell viability to each other. MT2 showed 43% cell viability relative to CCR5, and H1563 line specific amplified targets showed much more toxicity. ADAMTS16 resulted in 40% cell viability and IRX1 resulted in 37% cells that were alive compared to CCR5.

Example 19: Cell Death of A549 Cells by Multi-Target 2

FIG. 12-FIG. 13 shows cell death of A549 cells by multi-target 2. 500 ng of Cas9 protein and gRNA-expressing DNA were introduced into A549 (pancreatic) cells by electroporation. The cultured A549 cells were washed with 1×PBS, and removed from the floor using trypsin-EDTA. The required number of cells was removed and washed once with 1×PBS. Cells were resuspended with Lonza SF buffer at 20 µL/each for each condition and mixed with each DNA. The cell and DNA mixture was transferred to a Lonza electroporator and electric shocked. As a control, NT1 (non target), which is not aligned in the human genome, HPRT1, which is a house keeping gene, and CCR5, which has 1 copy, and electric shock only condition were added. After introducing DNA by electric shock, cells were plated into 24 wells in duplicate and 96 wells in 3 replicates. After 24, 42 and 72 hours of DNA introduction, 50 µL of CellTiter Glo reagent (Promega, G9241) was added to the 96 well plate. Plates were placed on a FLUOstar omega reader machine and shaken for 2 minutes and allowed to react for 10 minutes at room temperature. Afterwards, the degree of luminescence was measured. This method is based on the amount of ATP in the cell, and the amount of living cells undergoing metabolism is determined by absorbance. As compared to the three control conditions, the MT2 (multitarget 2) condition targeting over 100 sites in the human genome, 20~50% cell death was induced over time. In addition, three CNV targets of CD68, DACH2, and HERC2P2 induced cell death similar to MT2 and SHBG2 CNV target induced 70~80% cell death compared to control condition. After 24 hours of DNA introduction, 1 µg/mL of puromycin was added to the 24 well, and the cells were recovered by changing the cell culture medium at the time of almost cell death. After recovery for 5~7 days, cells were removed from each well and stained with trypan blue to determine the number of viable cells. After the DNA was introduced, the cells were selected with puromycin and then observed under a microscope before measuring the number of cells. Similar to the results of cell counting, in HPRT1, CCR5 targeted treatments, more than 50% of the cells were recovered, whereas 90% cell death was observed in MT2 targeting treatments and only 10% of the cells was recovered. Therefore, it was confirmed that the cell death was induced when the CNV target DNA break was induced using the Cas9 protein in A549 cells.

Example 20: Electroporation Lonza: A549 (CellTiter Glo), Cell Death of A549 Cells by CNV Target A549 (pancreatic) cells were transfected with 500 ng of Cas9 protein and DNA encoding each CNV target gRNA by electroporation. The cultured A549 cells were washed with 1×PBS, and removed from the floor using trypsin-EDTA. The required number of cells was removed, washed once with 1×PBS. Cells were resuspended with Lonza SF buffer at 20 µL/each condition, and mixed with each DNA. The cell and DNA mixture was transferred to a Lonza electroporator and subject to electric shock. As controls, a condition in which a pET21a vector capable of expressing a protein in *E. coli*, an electric shock only condition, and no treatment were added. After introducing DNA by electric shock, the cells were added to the 96 wells in 3 replicates per each condition. After 24, 44, and 51 hours of DNA introduction, 50 µL of CellTiter Glo reagent was added to each well. Plates were placed in a FLUOstar omega reader and shaken for 2 minutes. After reacting at room temperature for 10 minutes, the luminescence was measured. This method involves metabolism based on the amount of ATP in the cell Is the method of determining the degree of living cells by absorbance. As a result, 20~50% cell death was induced over time in MT2 (multitarget 2) conditions, targeting over 100 sites in human genome, compared with the three control conditions. In addition, the three CNV targets of CD68, DACH2, and HERC2P2 observed a similar degree of cell death to the MT2 condition, and SHBG CNV target induced 70~80% cell death compared to control conditions. Therefore, it was confirmed that the cell death was induced when the CNV target DNA break was induced using the Cas9 protein in A549 cells.

Example 21: Cell Death of SKBR3 Cells by CNV Target

SKBR3, a breast cancer cell line, was treated with 500 ng of Cas9 protein and DNA expressing each CNV target gRNA by electroporation. The cultured SKBR3 cells were washed with 1×PBS, and then treated with trypsin-EDTA and removed from the bottom. The required number of cells was removed, washed once with 1×PBS. Cells were resuspended with Lonza SF buffer 20 µL/each condition, and mixed with each DNA. The cell and DNA mixture was placed in a Lonza electroporator and subjected to electrical shock. NT1 (non target), not aligned in the human genome, electric shock only condition, and no treatment condition were added as control conditions. After introducing DNA by electric shock, cells were inserted into the 96 wells in 3 replicates per each condition. 24, 42 and 48 hours after DNA introduction, 50 µL of CellTiter Glo reagent was added to 96 wells. Plates were placed in a FLUOstar omega reader and shaken for 2 minutes. After reacting at room temperature for 10 minutes, the luminescence was measured. This method was based on the amount of ATP in the cell, and the amount of living cells undergoing metabolism was determined by absorbance. As a result, 30% cell death was induced in the MT2 condition targeting over 100 sites in human genome, compared to three control conditions. In addition, two CNV targets, ERBB2 and KRT1,6 induced 40~50% cell death compared to control conditions. After introducing DNA by electric shock, the cells were put into 24 wells in duplicate. 48 hours after the introduction of the DNA, the cells were removed from each well of 24 wells and stained with trypan blue to measure the number of living cells. As a result, 40% cell death was induced in MT2 condition compared to control condition, and 2 types of ERBB2 and KRT16 CNV targets induced 40~50% cell death compared with control condition. Therefore, it was confirmed that cell death was induced by inducing target DNA break using Cas9 protein in two CNVs of SKBR3 cells.

Example 22: Targeting the HeLa CNV or HPV Gene for Treatment of Cervical Cancer Shown in FIG. 18A is an HPV duplicated loci map in the HeLa genome from Adey, A. et al. (The haplotype-resolved genome and epigenome of the aneuploid HeLa cancer cell line. Nature 500, 207-211 (2013)). Purple indicates HeLa and green indicates HPV. Shown in FIG. 18B is HPV sequence regions in a HeLa cell, inferred from Meissner et al. (Nucleotide sequences and further characterization of human papillomavirus DNA present in the CaSki, SiHa and HeLa cervical carcinoma cell lines. *J. Gen. Virol.* 80, 1725-1733 (1999)), Landry et al. (The genomic and transcriptomic landscape of a HeLa cell line. *G3:Genes|Genomes|Genetics* 3, 1213-24 (2013)), Adey, and Liu et al. (Comprehensive mapping of the human papillomavirus (HPV) DNA integration sites in cervical carcinomas by HPV capture technology. *Oncotarget* 7, 5852-5864 (2016)). Repeat numbers are marked as X and only opened sequences are marked as arrow. Shown in FIG. 18C is an electrophoresis gel of PCR product which indicate the repeat region between HPV sequences in a HeLa cell, based on Meissner, Landry, Adey, and Liu.

600 ng of a DNA vector expressing Cas9 and gRNA was electroporated in $2\times10^5$ cells of a cervical cancer model cell (HeLa cell). To prepare HeLa cells, media was removed from the flask, cells were washed with 1×PBS, and cells were treated with Trypsin-EDTA to detach the HeLa cells from the flask. Cell counting was performed, the appropriate number of cells was transferred to a new tube, cells were washed with 1×PBS, and cells were resuspended with Lonza SE buffer and mixed with the DNA vector. The mixture was transferred to an eletroporator and electroporation was carried out. A plasmid targeting a non essential gene, CCR5, whose copy number is one, was used as a negative control, and a mixture of plasmids targeting 100 non essential genes (MT2) was used as positive control. In the experimental group, plasmid targeting the non essential gene PRDM9 duplicated 8 times and the human papillomavirus(HPV) gene duplicated 30 times in HeLa cell were targeted. 24 hours after introducing DNA by electroporation, the media was removed and replaced with 0.5 ug/ml puromycin to select transfected HeLa cell. 3 days after puromycin selection, media was replaced with standard media, cells were cultivated for 3~4 days, and cells were counted. FIG. 19 shows graphs of cell viability for each group. The data demonstrated that targeting MT2 induces cell death up to 50% as compared to the negative control, CCR5. In addition, targeting PRDM9 and HPV_1 sequences induced cell death similar to or more than targeting MT2. Therefore, Hela cell specific CNV & HPV genes were cut by Cas9 and cell death was induced.

FIG. 20 was generated using the same methods described above. 24, 48, and 72 hours post-electroporation, the amount of living cells undergoing metabolism was measured using Cell Titer Glo 2.0, which quantitates ATP by measuring luminescence absorbance. A GFP expressing vector (GFP) was used and the non essential gene CCR5, whose copy number is one, was used as a negative control. A mixture of plasmid targeting 100 non essential genes (MT2) was used as a positive control. In experimental groups, plasmids targeted the non essential gene PRDM9, duplicated 8 times, and the human papillomavirus(HPV) gene, duplicated 30 times in a HeLa cell. FIG. 20A shows graphs of the luminescence signal, or ATP level, for each treatment group at each time point. The data demonstrated that in HeLa cells, there is a similar luminescence signal between pulse only (GFP) and CCR5. Targeting MT2 induced cell death up to 50% as compared to the negative control, CCR5. In addition, targeting PRDM9 and HPV_1 sequences induced cell death similar to or more than the MT2 condition. HeLa cell death after targeting the HPV gene was assesed by a cell titer glo assay, as follows. FIG. 20B was generated using the same methods described above. A plasmid was used to target a non essential gene, CCR5, whose copy number is one as negative control, and a mixture of plasmids targeting 100 non essential gene(MT2) was used as positive control. A non-target negative control (NT1) was added, which targets non-human sequence. The NT1 control has a 20mer spacer, and NT2/NT3 have 10mer, 5mer spacer each. As the experimental group, a plasmid targeting human papillomavirus (HPV): gene was used, which is duplicated 30 times in HeLa cell. 24 hours after introducing DNA by using electroporation, media was removed and replaced with 0.5 ug/ml puromycin to select for transfected HeLa cell. 3 days after puromycin selection, media was replaced with standard media, cultivated for 10 days. The relative amount of living cells undergoing metabolism was calculated by Cell titer Glo. As a result of experiments, in HeLa cell, CCR5 showed 75% luminescence signal than NT3 whose spacer sequence are 5mer. Also, targeting MT2 induced cell death up to 99.5% than NT3. In addition, targeting HPV_1 sequence induced cell death up to about 90% than CCR5 condition. Therefore, when Hela cell specific HPV gene was cut by Cas9, cell death was induced, as detected by a Cell Titer Glo.

Example 23: HT29 Transfection Targeting Colon Cancer Relevant Genes

HT29 cells were plated at 1.5×10⁵ cells per well in a 24-well plate, and 500 ng of plasmids were introduced into each wells as described in TABLE 11.

TABLE 11

| | Lipo only | GFP | NT1 | CCR5 | HPRT1 | MT2 | TRAPPC9 | LINC00536 | TRPS1 | CDK8 |
|---|---|---|---|---|---|---|---|---|---|---|
| cut number | N/A | 0 | 2 | 2 | 2 | >100 | >13 | >9 | >8 | >18 |
| essentiality | N/A | N/A | N/A | Non-essential | House-keeping | Non-essential | Non-essential | Non-essential | Non-essential | Oncogene |

Transfection was performed at time point 24 hours after from cell plating, by using Lipofectamine3000 reagent according to manufacturer's protocol. 24 hours post-transfection, cells were treated with 1 μg/mL of puromycin and cells were selected at 90 hours. Almost total cell death was observed because of the low efficiency of transfection, and a few survived cells were recovered by normal complete McCOY media at 12 days. All supernatant was discarded by suction, and cells were washed gently by 500 μL of 1×PBS. Cells were harvested by trypsinization, and live cell number was counted with trypan blue dye and cell countess. FIG. 21 shows the live cell count per treatment group. CCR5, the target only making two cuts in whole genome, and NT1, having no matched sequence in a human genome, showed similar high levels of cell viability. Whereas, HPRT1, making two cuts in house keeping gene showed about 50% cell viability compared to NT1. Multiple cut making targets showed heavy cell death, especially MT2, TRAPPC9, and CDK8, which showed little or no recovered cells. LINK00536 and TRPS1 showed 18% and 20% cell viability compared to NT1 respectively.

Example 24: Target Cross Check (1299 Targets in 1563)

FIG. 22 was performed alongside the H1563 transfection shown in FIG. 13. H1563 cells were plated as 1.5×10⁵ cells per well in a 24-well plate, and 500 ng of plasmids were introduced into each wells as described above in TABLE 12 below.

TABLE 12

| | CCR5 | SMIM11 | GNPDA2 | SLC15A5 | KCNE2 |
|---|---|---|---|---|---|
| cut number | 2 | 2 | 2 | 2 | 2 |
| essentiality | Non essential | Non essential | oncogene | oncogene | Non essential |

Transfection was performed 24 hours after cell plating, by using Lipofectamine3000 reagent according to the manufacturer's protocol. 24 hours post-transfection, cells were treated with 1 μg/mL of puromycin and selected at 72 hours. All supernatant was discarded by suction, and cells were washed gently by 500 μL of 1×PBS. Cells were harvested by trypsinization, and the live cell number was counted with trypan blue dye and cell countess. FIG. 22 shows a graph of live cells in each treatment group. H1299 line specific CNV targets SMIM11, GNPDA2, SLC15A5, KCNE2 were tested in H1563, where they only make two cuts in the whole genome. As expected, SMIM11, GNPDA2, SLC15A5 showed no harmful effects compared to CCR5. KCNE2 showed cell death effect. This phenomenon was also confirmed in microscopic images (FIG. 23).

Example 25: Lipofection in H1299 Cells, Dead Cell Determination by Annexin V Positive Determinations One day before transfection, H1299 cells, a lung cancer cell line, were plated in a white 96-well plate at 1.3×10⁴. On the next day, 500 ng of Cas9 protein and DNA encoding each CNV target gRNA was introduced using liposomes. 0.3 μL of liposome reagent I was mixed with 5 μL of opti-MEM to make tube 1. 0.2 μL of liposome reagent II was mixed with 5 μL of opti-MEM and 500 ng of DNA for each experimental condition to make tube 2. Tube 2 was mixed with tube 1 and incubated at room temperature for 15 minutes. 11 μL of liposome and DNA mixture was added to 96 wells. After 3 hours, AnnV reagent as added and the degree of luminescence was measured 24 hours after lipofection. This method measures the extent of apoptosis according to the degree of luminescence when AnnV is added to the PS (phosphatidylserine) site exposed to the outer cell membrane when apoptosis occurs. As a result, when the target DNA break was induced by using Cas9 protein in the four CNVs of H1299 cells, and 30% to 40% cell death rate was observed. The cell membrane was exposed to PS to induce apoptosis. FIG. 24 shows a graph of luminescence, indicating cell death, for each treatment group.

Example 26: Cas9 Guide RNA Derived Multi-Cleavage Induction and Cell Death in EGFR Mutant Lung Cancer Cell Line, HCC827, and Enhancing Cell Killing Effect by Human Codon-Optimized Rec J Proteins A Cas9 expression vector (PX459, Addgene plasmid #62988) with mutant specific guide RNA was used to induce multi-cleavage in an EGFR mutant lung cancer genome. A vector expressing Cas9-RecJ protein was cloned, wherein the Cas9 sequence was flanked by human codon-optimized Rec J sequence at the 3' end. HCC827, a lung adenocarcinoma cell line, was electroporated for delivery of the Cas9/sgRNA expression vector. HCC827 cells have an E2 mutation in their EGFR gene and there are more than 18 copies of the mutation sequence in the specific genome. The guide RNA was designed so that it targets more than 18 loci in HCC827 cell line. Cells were grown in 75T flask using RPMI-1640 (10% fetal bovine serum) until they filled around 50% of the area, trypsinized, washed with PBS, and finally resuspended in Neon Electroporation Buffer R. 150,000 cells with 500 ng of the Cas9/sgRNA expression were loaded in a 10 µL Neon Pipette tip, and electroporated with an optimized condition (1300V, 20 ms, 2 pulses). Cells were recovered in the growth media for 4 days and counted. FIG. 25, at bottom, shows a graph of live cells in each treatment group. Compared to the control groups that were electroporated without any vectors, with vectors that target the wild-type EGFR sequence, or with a vector targeting a single locus (CCR5), the experimental group that was electroporated with vectors that target the HCC827 specific mutation had significantly lower number of cells. 33% cell death was observed in the EGFR_E2 experimental group. Moreover, it was confirmed that the Cas9RecJ protein not only enhanced the multi-cleavage effect, but it also conferred cell killing capability to single loci targeting guide RNAs. The results showed that multi-cleavage induction in an adenocarcinoma by Cas9 and target specific guide RNA reduced cell proliferation, and the effects were enhanced with human codon-optimized Rec J proteins. 50% cell death was observed in the CCR5 group and 80% cell death was observed in the EGFR_E2 group. Using the Cas9-RecJ constructs increased the cell death efficiecy by 5-fold as compared to the control.

Example 26: Various Delivery Methods. This Example Illustrates Various Delivery Methods to Administer CRISPR-Cas9 Constructs RNP neon electroporation in HCC827 cells. FIG. 26 shows Cas9 guide RNA derived multi-cleavage induction and cell death in an EGFR mutant lung cancer cell line, HCC827. A Cas9/sgRNA ribonucleoprotein (Cas9 RNP) with mutant specific guide RNA was used to induce multi-cleavage in the EGFR mutant lung cancer genome. HCC827, a lung adenocarcinoma cell line, was electroporated for delivery of the Cas9 RNPs. HCC827 has E2 mutation in its EGFR gene and there are more than 18 copies of the mutation sequence in the specific genome. The guide RNA was designed to target more than 18 loci in HCC827 cell line. Cells were grown in 75T flask using RPMI-1640 (10% fetal bovine serum) until they fill up around 50% of the area, trypsinized, washed with PBS, and finally resuspended in Neon Electroporation Buffer R. 150,000 cells with 1.2 µM of RNPs were loaded in a 10 µL Neon Pipette tip, and electroporated with an optimized condition (1300V, 20 ms, 2 pulses). Cells were recovered in the growth media for 24 hours and counted. Compared to the control groups that was electroporated without any complete RNPs, the experimental group electroporated with RNPs targeting the HCC827 specific mutation had significantly lower number of cells by 3-fold as compared to the non-targeted RNP. The results showed that multi-cleavage induction in a adenocarcinoma by Cas9 and target specific guide RNA reduced cell proliferation.

Lipofection of Cas9 Constructs in H1563 cells. FIG. 27 shows Cas9 guide RNA derived multi-cleavage induction and cell death in an adenocarcinoma cell line, H1563. A Cas9/sgRNA ribonucleoprotein (Cas9 RNP) with a guide RNA was used to target more than 100 loci in human genome. H1563, a lung adenocarcinoma cell line, was electroporated for the delivery of the Cas9 RNPs. Cells were grown in 75T flask using RPMI-1640 (10% fetal bovine serum) until they fill up around 50% of the area, trypsinized, washed with PBS, and finally resuspended in Neon Electroporation Buffer R. 150,000 cells with 1.204 of RNPs were loaded in a 10 µL Neon Pipette tip, and electroporated with an optimized condition (1200V, 20 ms, 2 pulses). Cells were than recovered in the growth media for 48 hours and counted. Compared to the control groups that was electroporated with non-targeted RNPs, the experimental group that was electroporated with RNPs that target the multiple loci had significantly lower number of cells by 30%. The results showed that multi-cleavage induction in a adenocarcinoma by Cas9 and target specific guide RNA reduced cell proliferation.

H1299 RNP (Cas9-GFP) 2 days after Neon electroporation. FIG. 28 shows Cas9 guide RNA derived multi-cleavage induction and cell death in an adenocarcinoma cell line, H1299. Cas9/sgRNA ribonucleoproteins (Cas9 RNPs) with mutant specific guide RNAs was used to induce multi-cleavage in the H1299 lung cancer cell line. Genes with high copy-number variation (CNV): in H1299 genome were searched and GNPDA2 (>12 copies, oncogene) and SMIM11 (>40 copies, non-essential gene) were selected as Cas9 targets. A guide RNA (MT2) was designed that targets more than 100 loci in human genome and used it for the experiment. H1299, a lung adenocarcinoma cell line, was electroporated for the delivery of the Cas9 RNPs. GFP-tagged Cas9 proteins were used to verify the transfection. Cells were grown in 75T flask using RPMI-1640 (10% fetal bovine serum) until they fill up around 50% of the area, trypsinized, washed with PBS, and finally resuspended in Neon Electroporation Buffer R. 150,000 cells with 1.204 of RNPs were loaded in a 10 µL Neon Pipette tip, and electroporated with an optimized condition (1300V, 20 ms, 2 pulses). Cells were than recovered in the growth media for 48 hours and counted. Compared to the control groups that was electroporated without any complete RNPs, the experimental groups that were electroporated with RNPs that target multiple loci in the H1299 genome had significantly lower numbers of cells. 71% cell death was observed in the GNPDA2 expeirmental group, 40% cell death was observed in the SMIM11 experimental group, and 33% cell death was observed in the MT2 experimental group. The results showed that multi-cleavage induction in a adenocarcinoma by Cas9 and target specific guide RNA reduced cell proliferation.

Example 27: Cell Death of HT-29 Cells by Targeting CNVs. To Assay Specific Killing in HT-29 (Colon Cancer Cell Line) by Targeting CNV and MT2

HT-29 cells were introduced with 500 ng of Cas9 protein and DNA expressing each CNV target gRNA by electroporation. The cultured HT-29 cells were washed with 1×PBS, and then treated with trypsin-EDTA and removed from the bottom. The required number of cells was removed and washed once with 1×PBS. Cells were resuspend with Lonza SF buffer 20 pt/each condition, and mixed with each DNA. The cell and DNA mixture was placed in a Lonza electroporator and subjected to electrical shock. NT1 (non target), which is not aligned in the human genome and electric shock only condition were added as control conditions. After introducing DNA by electric shock, cells were inserted into the 96 wells in 4 replicates per each condition. After 24 hours of DNA introduction, 50 pt of CellTiter Glo reagent was added to 96 wells. Plates were placed in a FLUOstar omega reader and shaken for 2 minutes. After reacting at room temperature for 10 minutes, the luminescence was measured. This method is based on the amount of ATP in the cell, and the amount of living cells undergoing metabolism is determined by absorbance. As a result, 90% cell death was induced in the TRAPPC9 and MT2 condition targeting over 100 sites in human genome, compared to NT1 conditions. In addition, three CNV targets, CDK8, LINC00536 and TRPS1 induced 20 ~45% cell death, as shown in FIG. 29.

Example 28: Sequence Specific Cancer Cell Killing Effect by Cas12a and Single or Multi-Target crRNAs A Cas12a expression vector was used with crRNAs that target a high CNV mutation sequence (EGFR_E2) or a non-CNV WT sequence (CCR5). The crRNAs were designed to induce either >18 cleavages or a double cleavage in HCC827 genome, respectively. HCC827, a lung adenocarcinoma cell line, was electroporated for the delivery of the Cas12a/crRNA expression vector. HCC827 has the E2 mutation in its EGFR gene and there are more than 18 copies of the mutation sequence in the specific genome. The Cas12a DNA sequence used was (SEQ ID NO: 3286)
```
ATGGGCAAAAACCAAAATTTCCAAGAATTTATCGGAGTGAGCCCCCTGCAGAAaACCCTC
CGGAACGAGCTTATTCCGACTGAGACCACAAAGAAAAATATAACCCAGCTGGACTTGCTG
ACTGAAGATGAGATCCGCGCCCAGAACCGGGAAAAGCTCAAAGAGATGATGGACGATTA
TTACCGCAATGTTATTGACAGTACCCTTCACGTCGGGATCGCTGTGGATTGGTCTTATCTG
TTCAGCTGCATGCGGAACCATTTGCGCGAAAATTCCAAGGAGTCAAAACGGGAACTGGAG
CGCACACAGGACAGCATTCGGAGTCAGATACACAACAAGTTTGCCGAACGCGCAGATTTC
AAAGACATGTTTGGCGCCTCTATCATTACCAAGCTCCTTCCTACTTACATCAAACAAAATA
GCGAGTATTCCGAACGGTACGATGAGTCAATGGAAATTCTGAAGTTGTATGGTAAATTCA
CCACAAGCCTGACCGACTACTTTGAGACTCGCAAGAACATATTCAGTAAAGAAAAGATCT
CTAGCGCTGTAGGCTATCGGATTGTGGAGGAAAATGCCGAGATCTTTCTCCAGAACCAGA
ATGCATACGATCGCATTTGTAAAATAGCCGGACTTGACCTGCATGGGTTGGATAACGAAA
TCACCGCTTATGTTGACGGCAAGACACTGAAAGAGGTCTGCTCCGATGAAGGTTTCGCCA
AGGCAATTACCCAAGAGGGCATCGAtCGGTACAATGAAGCCATTGGAGCTGTGAACCAGT
ATATGAATCTCCTTTGTCAGAAAAACAAGGCCCTGAAACCCGGGCAATTTAAGATGAAAC
GCTTGCACAAGCAGATACTGTGCAAAGGCACTACCTCATTCGATATCCCGAAGAAATTTG
AGAATGACAAGCAGGTATACGATGCAGTGAACAGCTTCACAGAAATTGTTACCAAAAAT
AACGACCTCAAGCGGCTTCTGAATATCACTCAAAACGCCAATGATTATGACATGAACAAA
ATTTACGTCGTGGCTGATGCCTATAGTATGATATCTCAGTTTATCAGCAAGAAATGGAATT
TGATTGAGGAATGTCTGCTCGACTACTATTCCGATAACCTTCCAGGTAAGGGCAATGCAA
AAGAGAACAAGGTAAAAAAGGCCGTGAAAGAAGAGACCTACCGCTCAGTTAGCCAGCTG
AATGAAGTCATCGAGAAGTATTACGTGGAAAAAACAGGACAAAGTGTATGGAAGGTGGA
GTCTTATATTAGCTCCTTGGCTGAAATGATAAAACTGGAGCTCTGCCATGAAATCGACAA
CGATGAGAAGCACAATCTTATTGAgGACGATGAGAAAATCTCAGAAATTAAGGAGCTGTT
GGACATGTACATGGATGTTTTCCATATAATCAAAGTCTTTCGGGTGAACGAAGTACTGAA
TTTCGACGAGACCTTTTATAGCGAAATGGATGAGATTTACCAGGACATGCAGGAAATCGT
GCCCCTCTATAACCACGTTCGCAATTACGTCACTCAAAAGCCGTATAAACAGGAGAAGTA
CCGGCTTTATTTCCATACCCCTACACTGGCCAACGGGTGGAGTAAATCTAAGGAATACGA
TAATAACGCAATTATATTGGTGCGCGAGGACAAATATTACCTGGGCATCCTCAATGCCAA
GAAAAAGCCCAGCAAAGAAATTATGGCTGGTAAGGAGGATTGTTCCGAACACGCCTATG
CAAAAATGAACTACTATCTTCTGCCGGGCGCCAATAAGATGTTGCCAAAAGTATTTCTGTC
AAAGAAAGGAATCCAGGACTACCATCCCAGCAGTTATATTGTGGAGGGGTACAACGAAA
AGAAACACATAAAGGGCTCTAAAAATTTCGATATCCGGTTTTGCCGCGACCTCATTGATT
ATTTCAAGGAGTGTATCAAAAAGCATCCGGACTGGAACAAATTTAATTTCGAATTTAGCG
CTACCGAGACTTACGAAGATATTTCCGTTTTCTATCGGGAGGTCGAAAAGCAAGGTTACC
```

-continued
```
GCGTGGAGTGGACCTATATAAACTCAGAgGACATCCAGAAACTTGAGGAAGATGGCCAGC
TGTTTTTGTTCCAAATTTACAATAAGGACTTTGCCGTAGGAAGCACAGGGAAACCTAACCT
GCACACCCTCTATCTTAAGAATCTGTTCAGTGAGGAAAACTTGCGGGATATCGTGCTGAA
ACTCAATGGCGAGGCAGAAATTTTTTTCCGCAAGTCTAGCGTTCAGAAACCCGTCATACA
TAAGTGCGGTTCCATCCTTGTGAACCGGACTTACGAGATTACCGAATCAGGCACAACCCG
CGTACAGAGCATCCCGGAGAGTGAATATATGGAGCTGTAtCGGTATTTTAATTCTGAAAAA
CAAATTGAGTTGAGCGACGAAGCCAAGAAATACCTGGATAAGGTGCAGTGTAACAAAGC
TAAGACTGACATAGTTAAAGATTATCGCTACACCATGGACAAGTTCTTTATCCACCTCCCA
ATTACAATCAATTTCAAAGTCGATAAGGGAAACAATGTGAACGCCATTGCACAGCAATAT
ATAGCCGGGCGGAAAGACCTTCATGTAATCGGCATTGATCGCGGTGAGCGGAATCTGATC
TACGTGTCCGTTATTGACATGTATGGCCGCATATTGGAACAGAAGTCATTTAACCTGGTCG
AGCAGGTGAGCAGTCAAGGAACCAAACGGTACTATGATTACAAGGAAAAACTCCAGAAT
CGCGAGGAAGAGCGGGACAAGGCTCGCCAGTCTTGGAAAACTATCGGGAAGATTAAAGA
ACTTAAGGAGGGCTATCTGAGCTCCGTAATCCACGAAATTGCCCAAATGGTGGTTAAATA
CAACGCAATAATCGCCATGGAGGATTTGAATTATGGTTTCAAGCGGGGCCGCTTTAAAGT
CGAACGGCAGGTGTACCAGAAGTTCGAGACCATGCTGATTTCAAAACTCAACTATCTTGC
TGACAAGAGCCAAGCCGTAGATGAACCCGGAGGGATTCTGCGCGGCTACCAGATGACAT
ATGTGCCGGACAATATTAAAAACGTTGGTCGGCAGTGCGGCATAATCTTTTACGTCCCTGC
AGCCTATACCAGTAAGATTGATCCCACTACCGGATTCATCAATGCTTTTAAACGCGACGTG
GTATCTACAAACGATGCCAAGGAGAATTTCTTGATGAAATTTGACAGCATTCAATACGAT
ATAGAAAAGGGGCTGTTCAAATTTTCCTTCGACTATAAGAACTTTGCAACCCATAAACTC
ACTCTTGCCAAGACCAAATGGGATGTGTACACAAATGGCACCCGGATTCAGAACATGAAG
GTTGAGGGTCACTGGCTGTCAATGGAAGTCGAGTTGACTACCAAAATGAAGGAACTGCTC
GACGATAGCCATATTCCGTATGAGGAAGGCCAGAATATCCTTGACGATCTGCGCGAGATG
AAAGACATTACAACCATAGTGAACGGAATCTTGGAAATTTTCTGGCTGACTGTACAACTC
CGGAATAGTCGCATCGATAACCCAGACTACGATCGGATTATATCTCCCGTGCTTAATAAG
AACGGGGAGTTTTTCGACAGCGATGAATATAATTCCTACATCGACGCTCAGAAAGCCCCG
CTGCCTATTGATGCAGACGCCAACGGCGCTTTTTGTATCGCCTTGAAGGGTATGTATACCG
CAAATCAGATTAAAGAGAACTGGGTTGAAGGCGAGAAGCTGCCCGCCGATTGCCTCAAA
ATAGAACACGCTTCATGGCTTGCCTTCATGCAAGGAGAGCGCGGG
``` and the corresponding protein sequence was (SEQ ID NO: 3287)
```
MGKNQNFQEFIGVSPLQKTLRNELIPTETTKKNITQLDLLTEDEIRAQNREKLKEMMDDYYRN
VIDSTLHVGIAVDWSYLFSCMRNHLRENSKESKRELERTQDSIRSQIHNKFAERADFKDMFGA
SIITKLLPTYIKQNSEYSERYDESMEILKLYGKFTTSLTDYFETRKNIFSKEKI-
SSAVGYRIVEEN
AEIFLQNQNAYDRICKIAGLDLHGLDNEITAYVDGKTLKEVCSDEGFAKAITQEGIDRYNEAIG
AVNQYMNLLCQKNKALKPGQFKMKRLHKQILCKGTTSFDIPKKFENDKQVYDAVNSFTEIVT
KNNDLKRLLNITQNANDYDMNKIYVVADAYSMISQFISKKWNLIEECLLDYYSDNLPGKGNA
KENKVKKAVKEETYRSVSQLNEVIEKYYVEKTGQSVWKVESYISSLAEMIKLELCHEIDNDEK
HNLIEDDEKISEIKELLDMYMDVEHIIKVERVNEVLNEDETFYSEMDEIYQDMQEIVPLYNHVR
```

-continued

```
NYVTQKPYKQEKYRLYFHTPTLANGWSKSKEYDNNAIILVREDKYYLGILNAKKKPSKEIMA

GKEDCSEHAYAKMNYYLLPGANKMLPKVFLSKKGIQDYHPSSYIVEGYNEKKHIKGSKNFDI

RFCRDLIDYFKECIKKHPDWNKFNFEFSATETYEDISVFYREVEKQGYRVEWTYINSEDIQKLE

EDGQLFLFQIYNKDFAVGSTGKPNLHTLYLKNLFSEENLRDIVLKLNGEAEIFFRKSSVQKPVI

HKCGSILVNRTYEITESGTTRVQSIPESEYMELYRYFNSEKQIELSDEAKKYLDKVQCNKAKTD

IVKDYRYTMDKFFIHLPITINFKVDKGNNVNAIAQQYIAGRKDLHVIGIDRGERNLIYVSVIDM

YGRILEQKSFNLVEQVSSQGTKRYYDYKEKLQNREEERDKARQSWKTIGKIKELKEGYLSSVI

HEIAQMVVKYNAIIAMEDLNYGEKRGREKVERQVYQKFETMLISKLNYLADKSQAVDEPGGI

LRGYQMTYVPDNIKNVGRQCGIIFYVPAAYTSKIDPTTGFINAFKRDVVSTNDAKENFLMKFD

SIQYDIEKGLEKESFDYKNFATHKLTLAKTKWDVYTNGTRIQNMKVEGHWLSMEVELTTKM

KELLDDSHIPYEEGQNILDDLREMKDITTIVNGILEIFWLTVQLRNSRIDNPDYDRIIS-
PVLNKNG

EFFDSDEYNSYIDAQKAPLPIDADANGAFCIALKGMYTANQIKENWVEGEKLPADCLKIEHAS

WLAFMQGERG.
```

The EGFR WT crRNA sequence was Ggagatgttgcttctcttaat-tcc (SEQ ID NO: 3288), the CCR5 crRNA sequence was Tgcacagggtggaacaagatggat (SEQ ID NO: 3289), and the EGFR_E2 crRNA sequence was Ggagatgtcttgatagcgacggga (SEQ ID NO: 3290). The AsCpf1 handle was Taatttc-tactcttgtagat (SEQ ID NO: 3291).

Cells were grown in 75T flask using RPMI-1640 (10% fetal bovine serum) until they fill up around 50% of the area, trypsinized, washed with PBS, and finally resuspended in Neon Electroporation Buffer R. 150,000 cells with 500 ng of the Cas12a/crRNA expression were loaded in a 10 μL Neon Pipette tip, and electroporated with an optimized condition (1300V, 20 ms, 2 pulses). Cells were then recovered in the growth media for 6 days and the amount of the cells were measured using luminescence. Compared to the control group, EGFR WT, for which HCC827 has no corresponding sequence in its genome, the CCR5-targeted sample showed 76% death rate and the EGFR_E2-targeted sample showed 83% death rate. The results showed that the use of Cas12a can induce double- or multi-cleavage derived cancer cell death and the effect can be controlled by customized crRNA designs.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (3300 sequences)

SEQ ID NO: 1 - DNA, 32 bp, Homo sapiens
caaagtatgggctacagaaaccgtgccaaaag

SEQ ID NO: 2 - DNA, 32 bp, Homo sapiens
tgggaaaacctatcggaagaaggcaagcctcc

SEQ ID NO: 3 - DNA, 30 bp, Homo sapiens
ggggccaagaaattagagtcctcagaagag

SEQ ID NO: 4 - DNA, 31 bp, Homo sapiens
atgatgaagaaagaggaacgggcttggaaga

SEQ ID NO: 5 - DNA, 33 bp, Homo sapiens
catctcaggtttgttctgagacacctgatgacc

SEQ ID NO: 6 - DNA, 33 bp, Homo sapiens
atatacaggatatgcgaattaagaagaaacaaa

SEQ ID NO: 7 - DNA, 32 bp, Homo sapiens
taggaggccgagctctgttgcttcgaactcca

SEQ ID NO: 8 - DNA, 31 bp, Homo sapiens
tgaggaggtttcgacatggcggtgcagccga

SEQ ID NO: 9 - DNA, 32 bp, Homo sapiens
aaaaagatcaaagtgctgggctccggtgcgtt

SEQ ID NO: 10 - DNA, 33 bp, Homo sapiens
atcctctctctgaaatcactgagcaggagaaag

SEQ ID NO: 11 - DNA, 32 bp, Homo sapiens
caaagtatgggcttcagaaaccgtgccaaaag

SEQ ID NO: 12 - DNA, 32 bp, Homo sapiens
tgggaaaacctatcggtagaaggcaagcctcc

SEQ ID NO: 13 - DNA, 31 bp, Homo sapiens
ggggccaagaaaattagagtcctcagaagag

SEQ ID NO: 14 - DNA, 29 bp, Homo sapiens
atgatgaagaaaggaacgggcttggaaga

SEQ ID NO: 15 - DNA, 32 bp, Homo sapiens
catctcaggtttgttctagacacctgatgacc

SEQ ID NO: 16 - DNA, 33 bp, Homo sapiens
atatacaggatatgtgaattaagaagaaacaaa

SEQ ID NO: 17 - DNA, 31 bp, Homo sapiens
taggaggccgagctctttgcttcgaactcca

SEQ ID NO: 18 - DNA, 31 bp, Homo sapiens
tgaggaggtttcgacctggcggtgcagccga

SEQ ID NO: 19 - DNA, 32 bp, Homo sapiens
aaaaagatcaaagtgctgagctccggtgcgtt

SEQ ID NO: 20 - DNA, 33 bp, Homo sapiens
atcctctctctgaaatcactgcgcaggagaaag

SEQ ID NO: 21 - DNA, 20 bp, Homo sapiens
cggagatgtcttgatagcga

SEQ ID NO: 22 - DNA, 20 bp, Homo sapiens
agcttcctagcaagtaacag

SEQ ID NO: 23 - DNA, 20 bp, Homo sapiens
gcgcatcttccctttgttat

SEQ ID NO: 24 - DNA, 20 bp, Homo sapiens
gtccggaagaggaactagaa

SEQ ID NO: 25 - DNA, 20 bp, Homo sapiens
ctccgtgccgctggtttatt

SEQ ID NO: 26 - DNA, 20 bp, Homo sapiens
cagaagctctgcattcatcc

SEQ ID NO: 27 - DNA, 20 bp, Homo sapiens
ggtgatgtgagttctagtcc

SEQ ID NO: 28 - DNA, 20 bp, Homo sapiens
ggaccgattgtgagaaatgc

SEQ ID NO: 29 - DNA, 20 bp, Homo sapiens
gtgcccagtgtgatgatatt

SEQ ID NO: 30 - DNA, 20 bp, Homo sapiens
gcatggcttttggctgttcg

SEQ ID NO: 31 - DNA, 20 bp, Homo sapiens
gctgtgatttcaacaggacg

SEQ ID NO: 32 - DNA, 20 bp, Homo sapiens
agaccattggagactacacg

SEQ ID NO: 33 - DNA, 20 bp, Homo sapiens
atagtactaggctgcctcac

SEQ ID NO: 34 - DNA, 20 bp, Homo sapiens
catgctccgccacctctacc

SEQ ID NO: 35 - DNA, 20 bp, Homo sapiens
ctgcagcttcgaagcctcac

SEQ ID NO: 36 - DNA, 20 bp, Homo sapiens
cttgttgtggtttctcaacc

SEQ ID NO: 37 - DNA, 20 bp, Homo sapiens
ggaagacgccctcagaagat

SEQ ID NO: 38 - DNA, 20 bp, Homo sapiens
gcctgtaatcccagctactc

SEQ ID NO: 39 - DNA, 20 bp, Homo sapiens
caggctagagtgaaatggtg

SEQ ID NO: 40 - DNA, 20 bp, Homo sapiens
cttccttgtaccaacacgta

SEQ ID NO: 41 - DNA, 20 bp, Homo sapiens
caggtgtgtaccaacacgta

SEQ ID NO: 42 - DNA, 20 bp, Homo sapiens
ccaggagtaccagctgccat

SEQ ID NO: 43 - DNA, 20 bp, Homo sapiens
tcttcacatcatgcagcagc

SEQ ID NO: 44 - DNA, 20 bp, Homo sapiens
agtggccaggattgattcag

SEQ ID NO: 45 - DNA, 20 bp, Homo sapiens
gacagcagaatgaccttggt

SEQ ID NO: 46 - DNA, 20 bp, Homo sapiens
cctgtcttgttcccagtcat

SEQ ID NO: 47 - DNA, 20 bp, Homo sapiens
gtaagcttacctagagaccc

SEQ ID NO: 48 - DNA, 20 bp, Homo sapiens
gacaccctaacagggttatg

SEQ ID NO: 49 - DNA, 20 bp, Homo sapiens
ctcactgcagccttgacatc

SEQ ID NO: 50 - DNA, 20 bp, Homo sapiens
cgtccaagtgtgtgagtgag

SEQ ID NO: 51 - DNA, 20 bp, Homo sapiens
gtggaaacctcagagatgtc

SEQ ID NO: 52 - DNA, 20 bp, Homo sapiens
ggaccctatctgaatgtgca

SEQ ID NO: 53 - DNA, 20 bp, Homo sapiens
gtgcattccacgcgtaaaac

SEQ ID NO: 54 - DNA, 20 bp, Homo sapiens
tgcttattgccaccacctgc

SEQ ID NO: 55 - DNA, 20 bp, Homo sapiens
cctgcaggaaccctaaaata

SEQ ID NO: 56 - DNA, 20 bp, Homo sapiens
ccatattttagggttcctgc

SEQ ID NO: 57 - DNA, 20 bp, Homo sapiens
tgcaggtggtggcaataagc

SEQ ID NO: 58 - DNA, 20 bp, Homo sapiens
aatctcccccacccttaaga

SEQ ID NO: 59 - DNA, 20 bp, Homo sapiens
tgacatcaattattatacat

SEQ ID NO: 60 - DNA, 20 bp, Homo sapiens
gcatttctcagtcctaaaca

SEQ ID NO: 61 - DNA, 20 bp, Homo sapiens
gggtaaccgtgcggtcgtac

SEQ ID NO: 62 - DNA, 10 bp, Homo sapiens
gggtaaccgt

SEQ ID NO: 63 - protein, 9 aa, Artificial Sequence
  Description of Artificial Sequence: Synthetic peptide
RRRRRRRRR

SEQ ID NO: 64 - protein, 9 aa, Artificial Sequence
  Description of Artificial Sequence: Synthetic peptide
EEEEEEEEE

SEQ ID NO: 65 - DNA, 45 bp, Artificial Sequence
  Description of Artificial Sequence: Synthetic oligonucleotide
aattctaatacgactcactataggtaatttctactaagtgtagat

SEQ ID NO: 66 - DNA, 76 bp, Artificial Sequence
  Description of Artificial Sequence: Synthetic oligonucleotide
gttttagagctagaaatagcaagttaaaataaggctagtccgttatcaacttgaaaaagtggcaccgagtcggtgc

SEQ ID NO: 67 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 68 - protein, 1208 aa, Streptococcus pyogenes
MIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 69 - DNA, 3903 bp, Francisella tularensis
atgtcaatttatcaagaatttgttaataaatatagtttaagtaaaactctaagatttgagttaatcccacagggtaaaacacttgaaaacataaaagcaagaggtttgattttagatgatgagaaaagagctaaagactacaaaaaggctaaacaaataattgataaatatcatcagttttttatagaggagatattaagttcggtttgtattagcgaagatttattacaaaactattctgatgtttattttaaacttaaaaagagtgatgatgataatctacaaaaagattttaaaagtgcaaaagatacgataaagaaacaaatatctgaatatataaaggactcagagaaatttaagaatttgtttaatcaaaaccttatcgatgctaaaaaagggcaagagtcagatttaattctatggctaaagcaatctaaggataatggtatagaactatttaaagccaatagtgatatcacagatatagatgaggcgttagaaataatcaaatcttttaaaggttggacaacttattttaagggttttcatgaaaatagaaaaaatgtttatagtagcaatgatattcctacatctattatttataggatagtagatgataatttgcctaaatttctagaaaataaagctaagtatgagagtttaaaagacaaagctccagaagctataaactatgaacaaattaaaaaagatttggcagaagagctaacctttgatattgactacaaaacatctgaagttaatcaaagagttttttcacttgatgaagtttttgagatagcaaactttaataattatctaaatcaaagtggtattactaaatttaatactattattggtggtaaatttgtaaatggtgaaaatacaaagagaaaaggtataaatgaatatataaatctatactcacagcaaataaatgataaaacactcaaaaaatataaaatgagtgttttatttaagcaaattttaagtgatacagaatctaaatcttttgtaattgataagttagaagatgatagtgatgtagttacaacgatgcaaagtttttatgagcaaatagcagcttttaaaacagtagaagaaaaatctattaaagaaacactatctttattatttgatgatttaaaagctcaaaaacttgatttgagtaaaatttattttaaaaatgataaatctcttactgatctatcacaacaagtttttgatgattatagtgttattggtacagcggtactagaatatataactcaacaaatagcacctaaaaatcttgataaccctagtaagaaagagcaagaattaatagccaaaaaaactgaaaaagcaaaatacttatctctagaaactataaagcttgccttagaagaatttaataagcatagagatatagataaacagtgtaggtttgaagaaatacttgcaaactttgcggctattccgatgatatttgatgaaatagctcaaaacaaagacaatttggcacagatatctatcaaatatcaaaatcaaggtaaaaaagacctacttcaagctagtgcggaagatgatgttaaagctatcaaggatcttttagatcaaactaataatctcttacataaactaaaaatatttcatattagtcagtcagaagataaggcaaatattttagacaaggatgagcatttttatctagtatttgaggagtgctactttgagctagcgaatatagtgcctctttataacaaaattagaaactatataactcaaaagccatatagtgatgagaaatttaagctcaattttgagaactcgactttggctaatggttgggataaaaataaagagcctgacaatacggcaattttatttatcaaagatgataaatattatctgggtgtgatgaataagaaaaataacaaaatatttgatgataaagctatcaaagaaaataaaggcgagggttataaaaaaattgtttataaacttttacctggcgcaaataaaatgttacctaaggttttcttttctgctaaatctataaaattttataatcctagtgaagatatacttagaataagaaatcattccacacatacaaaaaatggtagtcctcaaaaaggatatgaaaaatttgagtttaatattgaagattgccgaaaatttatagatttttataaacagtctataagtaagcatccggagtggaaagattttggatttagattttctgatactcaaagatataattctatagatgaattttatagagaagttgaaaatcaaggctacaaactaacttttgaaaatatatcagagagctatattgatagcgtagttaatcagggtaaattgtacctattccaaatctataataaagatttttcagcttatagcaaagggcgaccaaatctacatactttatattggaaagcgctgtttgatgagagaaatcttcaagatgtggtttataagctaaatggtgaggcagagcttttttatcgtaaacaatcaatacctaaaaaaatcactcacccagctaaagaggcaatagctaataaaaacaaagataatcctaaaaaagagagtgtttttgaatatgatttaatcaaagataaacgctttactgaagataagtttttctttcactgtcctattacaatcaattttaaatctagtggagctaataagtttaatgatgaaatcaatttattgctaaaagaaaaagcaaatgatgttcatatattaagtatagatagaggtgaaagacatttagcttactatactttggtagatggtaaaggcaatatcatcaaacaagatactttcaacatcattggtaatgatagaatgaaaacaaactaccatgataagcttgctgcaatagagaaagatagggattcagctaggaaagactggaaaaagataaataacatcaaagagatgaaagagggctatctatctcaggtagttcatgaaatagctaagctagttatagagtataatgctattgtggtttttgaggatttaaattttggatttaaaagagggcgtttcaaggtagagaagcaggtctatcaaaagttagaaaaaatgctaattgagaaactaaactatctagttttcaaagataatgagtttgataaaactgggggagtgcttagagcttatcagctaacagcaccttttgagacttttaaaaagatgggtaaacaaacaggtattatctactatgtaccagctggttttacttcaaaaatttgtcctgtaactggttttgtaaatcagttatatcctaagtatgaaagtgtcagcaaatctcaagagttctttagtaagtttgacaagatttgttataaccttgataagggctattttgagtttagttttgattataaaaactttggtgacaaggctgccaaaggcaagtggactatagctagctttgggagtagattgattaactttagaaattcagataaaaatcataattgggatactcgagaagtttatccaactaaagagttggagaaattgctaaaagattattctatcgaatatgggcatggcgaatgtatcaaagcagctatttgcggtgagagcgacaaaaagttttttgctaagctaactagtgtcctaaatactatcttacaaatgcgtaactcaaaaacaggtactgagttagattatctaatttcaccagtagcagatgtaaatggcaatttctttgattcgcgacaggcgccaaaaaatatgcctcaagatgctgatgccaatggtgcttatcatattgggctaaaaggtctgatgctactaggtaggatcaaaaataatcaagagggcaaaaaactcaatttggttatcaaaaatgaagagtattttgagttcgtgcagaataggaataactaa

SEQ ID NO: 70 - protein, 1300 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 71 - protein, 215 aa, Unknown
  Description of Unknown: Exoribonuclease T sequence
MSDNAQLTGLCDRFRGFYPVVIDVETAGFNAKTDALLEIAAITLKMDEQGWLMPDTTLHFHVEPFVGANLQPEALAFNGIDPNDPDRGAVSEYEALHEIFKVVRKGIKASGCNRAIMVAHNANFDHSFMMAAAERASLKRNPFHPFATFDTAALAGLALGQTVLSKACQTAGMDFDSTQAHSALYDTERTAVLFCEIVNRWKRLGGWPLSAAEEV

SEQ ID NO: 72 - protein, 236 aa, Unknown
  Description of Unknown: TREX2 sequence
MSEAPRAETFVFLDLEATGLPSVEPEIAELSLFAVHRSSLENPEHDESGALVLPRVLDKLTLCMCPERPFTAKASEITGLSSEGLARCRKAGFDGAVVRTLQAFLSRQAGPICLVAHNGFDYDFPLLCAELRRLGARLPRDTVCLDTLPALRGLDRAHSHGTRARGRQGYSLGSLFHRYFRAEPSAAHSAEGDVHTLLLIFLHRAAELLAWADEQARGWAHIEPMYLPPDDPSLEA

SEQ ID NO: 73 - protein, 304 aa, Unknown [sequence omitted]

SEQ ID NO: 74 - protein, 1180 aa, Unknown
  Description of Unknown: RecBCD_RecB sequence
MSDVAETLDPLRLPLQGERLIEASAGTGKTFTIAALYLRLLLGLGGSAAFPRPLTVEELLVVTFTEAATAELRGRIRSNIHELRIACLRETTDNPLYERLLEEIDDKAQAAQWLLLAERQMDEAAVFTIHGFCQRMLNLNAFESGMLFEQQLIEDESLLRYQACADFWRRHCYPLPREIAQVVFETWKGPQALLRDINRYLQGEAPVIKAPPPDDETLASRHAQIVARIDTVKQQWRDAVGELDALIESSGIDRRKFNRSNQAKWIDKISAWAEEETNSYQLPESLEKFSQRFLEDRTKAGGETPRHPLFEAIDQLLAEPLSIRDLVITRALAEIRETVAREKRRRGELGFDDMLSRLDSALRSESGEVLAAAIRTRFPVAMIDEFQDTDPQQYRIFRRIWHHQPETALLLIGDPKQAIYAFRGADIFTYMKARSEVHAHYTLDTNWRSAPGMVNSVNKLFSQTDDAFMFREIPFIPVKSAGKNQALRFVFKGETQPAMKMWLMEGESCGVGDYQSTMAQVCAAQIRDWLQAGQRGEALLMNGDDARPVRASDISVLVRSRQEAAQVRDALTLLEIPSVYLSNRDSVFETLEAQEMLWLLQAVMTPERENTLRSALATSMMGLNALDIETLNNDEHAWDVVVEEFDGYRQIWRKRGVMPMLRALMSARNIAENLLATAGGERRLTDILHISELLQEAGTQLESEHALVRWLSQHILEPDSNASSQQMRLESDKHLVQIVTIHKSKGLEYPLVWLPFITNFRVQEQAFYHDRHSFEAVLDLNAAPESVDLAEAERLAEDLRLLYVALTRSVWHCSLGVAPLVRRRGDKKGDTDVHQSALGRLLQKGEPQDAAGLRTCIEALCDDDIAWQTAQTGDNQPWQVNDVSTAELNAKTLQRLPGDNWRVTSYSGLQQRGHGIAQDLMPRLDVDAAGVASVVEEPTLTPHQFPRGASPGTFLHSLFEDLDFTQPVDPNWVREKLELGGFESQWEPVLTEWITAVLQAPLNETGVSLSQLSARNKQVEMEFYLPISEPLIASQLDTLIRQFDPLSAGCPPLEFMQVRGMLKGFIDLVFRHEGRYYLLDYKSNWLGEDSSAYTQQAMAAAMQAHRYDLQYQLYTLALHRYLRHRIADYDYEHHFGGVIYLFLRGVDKEHPQQGIYTTRPNAGLIALMDEMFAGMTLEEA

SEQ ID NO: 75 - protein, 1122 aa, Unknown
  Description of Unknown: RecBCD_RecC sequence
MLRVYHSNRLDVLEALMEFIVERERLDDPFEPEMILVQSTGMAQWLQMTLSQKFGIAANIDFPLPASFIWDMFVRVLPEIPKESAFNKQSMSWKLMTLLPQLLEREDFTLLRHYLTDDSDKRKLFQLSSKAADLFDQYLVYRPDWLAQWETGHLVEGLGEAQAWQAPLWKALVEYTHQLGQPRWHRANLYQRFIETLESATTCPPGLPSRVFICGISALPPVYLQALQALGKHIEIHLLFTNPCRYYWGDIKDPAYLAKLLTRQRRHSFEDRELPLFRDSENAGQLFNSDGEQDVGNPLLASWGKLGRDYIYLLSDLESSQELDAFVDVTPDNLLHNIQSDILELENRAVAGVNIEEFSRSDNKRPLDPLDSSITFHVCHSPQREVEVLHDRLLAMLEEDPTLTPRDIIVMVADIDSYSPFIQAVFGSAPADRYLPYAISDRRARQSHPVLEAFISLLSLPDSRFVSEDVLALLDVPVLAARFDITEEGLRYLRQWVNESGIRWGIDDDNVRELELPATGQHTWRFGLTRMLLGYAMESAQGEWQSVLPYDESSGLIAELVGHLASLLMQLNIWRRGLAQERPLEEWLPVCRDMLNAFFLPDAETEAAMTLIEQQWQAIIAEGLGAQYGDAVPLSLLRDELAQRLDQERISQRFLAGPVNICTLMPMRSIPFKVVCLLGMNDGVYPRQLAPLGFDLMSQKPKRGDRSRRDDDRYLFLEALISAQQKLYISYIGRSIQDNSERFPSVLVQELIDYIGQSHYLPGDEALNCDESEARVKAHLTCLHTRMPFDPQNYQPGERQSYAREWLPAASQAGKAHSEFVQPLPFTLPETVPLETLQRFWAHPVRAFFQMRLQVNFRTEDSEIPDTEPFILEGLSRYQINQQLLNALVEQDDAERLFRRFRAAGDLPYGAFGEIFWETQCQEMQQLADRVIACRQPGQSMEIDLACNGVQITGWLPQVQPDGLLRWRPSLLSVAQGMQLWLEHLVYCASGGNGESRLFLRKDGEWRFPPLAAEQALHYLSQLIEGYREGMSAPLLVLPESGGAWLKTCYDAQNDAMLDDDSTLQKARTKFLQAYEGNMMVRGEGDDIWYQRLWRQLTPETMEAIVEQSQRFLLPLFRFNQS

SEQ ID NO: 76 - protein, 608 aa, Unknown
  Description of Unknown: RecBCD_RecD sequence
MKLQKQLLEAVEHKQLRPLDVQFALTVAGDEHPAVTLAAALLSHDAGEGHVCLPLSRLENNEASHPLLATCVSEIGELQNWEECLLASQAVSRGDEPTPMILCGDRLYLNRMWCNERTVARFFNEVNHAIEVDEALLAQTLDKLFPVSDEINWQKVAAAVALTRRISVISGGPGTGKTTTVAKLLAALIQMADGERCRIRLAAPTGKAAARLTESLGKALRQLPLTDEQKKRIPEDASTLHRLLGAQPGSQRLRHHAGNPLHLDVLVVDEASMIDLPMMSRLIDALPDHARVIFLGDRDQLASVEAGAVLGDICAYANAGFTAERARQLSRLTGTHVPAGTGTEAASLRDSLCLLQKSYRFGSDSGIGQLAAAINRGDKTAVKTVFQQDFTDIEKRLLQSGEDYIAMLEEALAGYGRYLDLLQARAEPDLIIQAFNEYQLLCALREGPFGVAGLNERIEQFMQQKRKIHRHPHSRWYEGRPVMIARNDSALGLFNGDIGIALDRGQGTRVWFAMPDGNIKSVQPSRLPEHETTWAMTVHKSQGSEFDHAALILPSQRTPVVTRELVYTAVTRARRRLSLYADERILSAAIATRTERRSGLAALFSSRE

SEQ ID NO: 77 - protein, 475 aa, Unknown
  Description of Unknown: Exodeoxyribonuclease I sequence
MMNDGKQQSTFLFHDYETFGTHPALDRPAQFAAIRTDSEFNVIGEPEVFYCKPADDYLPQPGAVLITGITPQEARAKGENEAAFAARIHSLFTVPKTCILGYNNVRFDDEVTRNIFYRNFYDPYAWSWQHDNSRWDLLDVMRACYALRPEGINWPENDDGLPSFRLEHLTKANGIEHSNAHDAMADVYATIAMAKLVKTRQPRLFDYLFTHRNKHKLMALIDVPQMKPLVHVSGMFGAWRGNTSWVAPLAWHPENRNAVIMVDLAGDISPLLELDSDTLRERLYTAKTDLGDNAAVPVKLVHINKCPVLAQANTLRPEDADRLGINRQHCLDNLKILRENPQVREKVVAIFAEAEPFTPSDNVDAQLYNGFFSDADRAAMKIVLETEPRNLPALDITFVDKRIEKLLFNYRARNFPGTLDYAEQQRWLEHRRQVFTPEFLQGYADELQMLVQQYADDKEKVALLKALWQYAEEIV

SEQ ID NO: 78 - protein, 268 aa, Unknown
  Description of Unknown: Exodeoxyribonuclease III sequence
MKFVSFNINGLRARPHQLEAIVEKHQPDVIGLQETKVHDDMFPLEEVAKLGYNVFYHGQKGHYGVALLTKETPIAVRRGFPGDDEEAQRRIIMAEIPSLLGNVTVINGYFPQGESRDHPIKFPAKAQFYQNLQNYLETELKRDNPVLIMGDMNISPTDLDIGIGEENRKRWLRTGKCSFLPEEREWMDRLMSWGLVDTFRHANPQTADRFSWFDYRSKGFDDNRGLRIDLLLASQPLAECCVETGIDYEIRSMEKPSDHAPVWATFRR

SEQ ID NO: 79 - protein, 355 aa, Vigna radiata
MQTLQMSLLTQPYVQPRFPCKRYPTFSASCRTQKTAITKTEKVFFSESFDQTRCTQPLSEKKKRVFFLDVNPLCYEGSKPSLRSFGRWLSLFLHQVSLTDPVIAVIDGEGGSEHRRKLLPSYKAHRKKFMRHMSSGHVGRSHQVINDVLGKCNVPVIKVAGHEADDVVATLAGQVVNKGFRVVIGSPDKDFKQLISEDVQIVMPLPELQRWSFYTLRHYRDQYNCDPESDLSFRCIVGDEVDGVPGIQHLVPSFGRKTAMKLIKKHGSLETLLNAAAIRTVGRPYAQDALKNHADYLRRNYEVLALKRDVNIQLYDEWLVKRDNHNDKTALSSFFKYLGESKELSYNGRPISYNG

SEQ ID NO: 80 - protein, 577 aa, Unknown
  Description of Unknown: RecJ sequence
VKQQIQLRRREVDETADLPAELPPLLRRLYASRGVRSAQELERSVKGMLPWQQLSGVEKAVEILYNAFREGTRIIVVGDFDADGATSTALSVLAMRSLGCSNIDYLVPNRFEDGYGLSPEVVDQAHARGAQLIVTVDNGISSHAGVEHARSLGIPVIVTDHHLPGDTLPAAEAIINPNLRDCNFPSKSLAGVGVAFYLMLALRTFLRDQGWFDERNIAIPNLAELLDLVALGTVADVVPLDANNRILTWQGMSRIRAGKCRPGIKALLEVANRDAQKLAASDLGFALGPRLNAAGRLDDMSVGVALLLCDNIGEARVLANELDALNQTRKEIEQGMQIEALTLCEKLERSRDTLPGGLAMYHPEWHQGVVGILASRIKERFHRPVIAFAPAGDGTLKGSGRSIQGLHMRDALERLDTLYPGMMLKFGGHAMAAGLSLEEDKFKLFQQRFGELVTEWLDPSLLQGEVVSDGPLSPAEMTMEVAQLLRDAGPWGQMFPEPLFDGHFRLLQQRLVGERHLKVMVEPVGGGPLLDGIAFNVDTALWPDNGVREVQLAYKLDINEFRGNRSLQIIIDNIWPI

SEQ ID NO: 81 - protein, 866 aa, Unknown
  Description of Unknown: RecE sequence
MSTKPLFLLRKAKKSSGEPDVVLWASNDFESTCATLDYLIVKSGKKLSSYFKAVATNFPVVNDLPAEGEIDFTWSERYQLSKDSMTWELKPGAAPDNAHYQGNTNVNGEDMTEIEENMLLPISGQELPIRWLAQHGSEKPVTHVSRDGLQALHIARAEELPAVTALAVSHKTSLLDPLEIRELHKLVRDTDKVFPNPGNSNLGLITAFFEAYLNADYTDRGLLTKEWMKGNRVSHITRTASGANAGGGNLTDRGEGFVHDLTSLARDVATGVLARSMDLDIYNLHPAHAKRIEEIIAENKPPFSVFRDKFITMPGGLDYSRAIVVASVKEAPIGIEVIPAHVTEYLNKVLTETDHANPDPEIVDIACGRSSAPMPQRVTEEGKQDDEEKPQPSGTTAVEQGEAETMEPDATEHHQDTQPLDAQSQVNSVDAKYQELRAELHEARKNIPSKNPVDDDKLLAASRGEFVDGISDPNDPKWVKGIQTRDCVYQNQPETEKTSPDMNQPEPVVQQEPEIACNACGQTGGDNCPDCGAVMGDATYQETFDEESQVEAKENDPEEMEGAEHPHNENAGSDPHRDCSDETGEVADPVIVEDIEPGIYYGISNENYHAGPGISKSQLDDIADTPALYLWRKNAPVDTTKTKTLDLGTAFHCRVLEPEEFSNRFIVAPEFNRRTNAGKEEEKAFLMECASTGKTVITAEEGRKIELMYQSVMALPLGQWLVESAGHAESSIYWEDPETGILCRCRPDKIIPEFHWIMDVKTTADIQRFKTAYYDYRYHVQDAFYSDGYEAQFGVQPTFVFLVASTTIECGRYPVEIFMMGEEAKLAGQQEYHRNLRTLSDCLNTDEWPAIKTLSLPRWAKEYAND

SEQ ID NO: 82 - protein, 276 aa, Unknown
  Description of Unknown: T5 sequence
MASRRNLMIVDGTNLGFRFKHNNSKKPFASSYVSTIQSLAKSYSARTTIVLGDKGKSVFRLEHLPEYKGNRDEKYAQRTEEEKALDEQFFEYLKDAFELCKTTFPTFTIRGVEADDMAAYIVKLIGHLYDHVWLISTDGDWDTLLTDKVSRFSFTTRREYHLRDMYEHHNVDDVEQFISLKAIMGDLGDNIRGVEGIGAKRGYNIIREFGNVLDIIDQLPLPGKQKYIQNLNASEELLFRNLILVDLPTYCVDAIAAVGQDVLDKFTKDILEIAEQ

SEQ ID NO: 83 - protein, 226 aa, Unknown
  Description of Unknown: Lambda exonuclease sequence
MTPDIILQRTGIDVRAVEQGDDAWHKLRLGVITASEVHNVIAKPRSGKKWPDMKMSYFHTLLAEVCTGVAPEVNAKALAWGKQYENDARTLFEFTSGVNVTESPIIYRDESMRTACSPDGLCSDGNGLELKCPFTSRDFMKFRLGGFEAIKSAYMAQVQYSMWVTRKNAWYFANYDPRMKREGLHYVVIERDEKYMASFDEIVPEFIEKMDEALAEIGFVFGEQWR

SEQ ID NO: 84 - protein, 80 aa, Unknown
  Description of Unknown: Exonuclease VII small unit sequence
MPKKNEAPASFEKALSELEQIVTRLESGDLPLEEALNEFERGVQLARQGQAKLQQAEQRVQILLSDNEDASLTPFTPDNE

SEQ ID NO: 85 - protein, 456 aa, Unknown
  Description of Unknown: Exonuclease VII large unit sequence
MLPSQSPAIFTVSRLNQTVRLLLEHEMGQVWISGEISNFTQPASGHWYFTLKDDTAQVRCAMFRNSNRRVTFRPQHGQQVLVRANITLYEPRGDYQIIVESMQPAGEGLLQQKYEQLKAKLQAEGLFDQQYKKPLPSPAHCVGVITSKTGAALHDILHVLKRRDPSLPVIIYPAAVQGDDAPGQIVRAIELANQRNECDVLIVGRGGGSLEDLWSFNDERVARAIFTSRIPVVSAVGHETDVTIADFVADLRAPTPSAAAEVVSRNQQELLRQVQSTRQRLEMAMDYYLANRTRRFTQIHHRLQQQHPQLRLARQQTMLERLQKRMSFALENQLKRTGQQQQRLTQRLNQQNPQPKIHRAQTRIQQLEYRLAETLRAQLSATRERFGNAVTHLEAVSPLSTLARGYSVTTATDGNVLKKVKQVKAGEMLTTRLEDGWIESEVKNIQPVKKSRKKVH

SEQ ID NO: 86 - DNA, 15 bp, Homo sapiens
ggaattaagagaagc

SEQ ID NO: 87 - protein, 5 aa, Homo sapiens
ELREA

SEQ ID NO: 88 - DNA, 28 bp, Artificial Sequence
  Description of Artificial Sequence: Synthetic oligonucleotide
tttgatagcgacgggaattttaactttc

SEQ ID NO: 89 - DNA, 28 bp, Artificial Sequence
  Description of Artificial Sequence: Synthetic oligonucleotide
ttttttcttagaactattgccattggag

SEQ ID NO: 90 - DNA, 28 bp, Artificial Sequence
  Description of Artificial Sequence: Synthetic oligonucleotide
tttcgacatattgtggtggtgccctatg

SEQ ID NO: 91 - DNA, 35 bp, Homo sapiens
tcgctatcaaggaattaagagaagcaacatctccg

SEQ ID NO: 92 - DNA, 20 bp, Homo sapiens
tagttctaagaaaaattcca

SEQ ID NO: 93 - DNA, 21 bp, Homo sapiens
caccaccacactatgtcgaaa

SEQ ID NO: 94 - DNA, 20 bp, Artificial Sequence
  Description of Artificial Sequence: Synthetic oligonucleotide
tcgctatcaaaacatctccg

SEQ ID NO: 95 - DNA, 21 bp, Artificial Sequence
  Description of Artificial Sequence: Synthetic oligonucleotide
tagttctaagaaaaaattcca

SEQ ID NO: 96 - DNA, 21 bp, Artificial Sequence
  Description of Artificial Sequence: Synthetic oligonucleotide
caccaccacaatatgtcgaaa

SEQ ID NO: 97 - DNA, 69 bp, Artificial Sequence
  Description of Artificial Sequence: Synthetic oligonucleotide
aattctaatacgactcactataggtaatttctactaagtgtagatatagcgacgggaattttaactttc

SEQ ID NO: 98 - DNA, 69 bp, Artificial Sequence
  Description of Artificial Sequence: Synthetic oligonucleotide
aattctaatacgactcactataggtaatttctactaagtgtagatttcttagaactattgccattggag

SEQ ID NO: 99 - DNA, 69 bp, Artificial Sequence
  Description of Artificial Sequence: Synthetic oligonucleotide
aattctaatacgactcactataggtaatttctactaagtgtagatgacatattgtggtggtgccctatg

SEQ ID NO: 100 - DNA, 15 bp, Homo sapiens
gaattaagagaagca

SEQ ID NO: 101 - DNA, 23 bp, Artificial Sequence
  Description of Artificial Sequence: Synthetic oligonucleotide
cggagatgtcttgatagcgacgg

SEQ ID NO: 102 - DNA, 23 bp, Artificial Sequence
  Description of Artificial Sequence: Synthetic oligonucleotide
taagaaaaaattccagcagatgg

SEQ ID NO: 103 - DNA, 23 bp, Artificial Sequence
  Description of Artificial Sequence: Synthetic oligonucleotide
tccggttcatgccgcccatgcgg

SEQ ID NO: 104 - DNA, 35 bp, Homo sapiens
cgctatcaaggaattaagagaagcaacatctccga

SEQ ID NO: 105 - DNA, 20 bp, Homo sapiens
tagttctaagaaaaattcca

SEQ ID NO: 106 - DNA, 21 bp, Homo sapiens
ccgcccatgcaggaactgtta

SEQ ID NO: 107 - DNA, 20 bp, Artificial Sequence
  Description of Artificial Sequence: Synthetic oligonucleotide
cgctatcaagacatctccga

SEQ ID NO: 108 - DNA, 21 bp, Artificial Sequence
  Description of Artificial Sequence: Synthetic oligonucleotide
ccgcccatgcgggaactgtta

SEQ ID NO: 109 - DNA, 119 bp, Artificial Sequence
  Description of Artificial Sequence: Synthetic polynucleotide
attctaatacgactcactataggcggagatgtcttgatagcgagttttagagctagaaatagcaagttaaaataaggctagtccgttatcaacttgaaaaagtggcaccgagtcggtgc

SEQ ID NO: 110 - DNA, 119 bp, Artificial Sequence
  Description of Artificial Sequence: Synthetic polynucleotide
attctaatacgactcactataggtaagaaaaaattccagcagagttttagagctagaaatagcaagttaaaataaggctagtccgttatcaacttgaaaaagtggcaccgagtcggtgc

SEQ ID NO: 111 - DNA, 119 bp, Artificial Sequence
  Description of Artificial Sequence: Synthetic polynucleotide
attctaatacgactcactataggtccggttcatgccgcccatggttttagagctagaaatagcaagttaaaataaggctagtccgttatcaacttgaaaaagtggcaccgagtcggtgc

SEQ ID NO: 112 - DNA, 28 bp, Artificial Sequence
  Description of Artificial Sequence: Synthetic oligonucleotide
tttcctcactggcttcagcgattccaca

SEQ ID NO: 113 - DNA, 69 bp, Artificial Sequence
  Description of Artificial Sequence: Synthetic oligonucleotide
aattctaatacgactcactataggtaatttctactaagtgtagatctcactggcttcagcgattccaca

SEQ ID NO: 114 - DNA, 21 bp, Homo sapiens
gctcctgcctcttcctcactg

SEQ ID NO: 115 - DNA, 21 bp, Artificial Sequence
  Description of Artificial Sequence: Synthetic oligonucleotide
gctcctgccttttcctcactg

SEQ ID NO: 116 - DNA, 28 bp, Artificial Sequence
  Description of Artificial Sequence: Synthetic oligonucleotide
ttttcctcactggcttcagcgattccac

SEQ ID NO: 117 - DNA, 69 bp, Artificial Sequence
  Description of Artificial Sequence: Synthetic oligonucleotide
aattctaatacgactcactataggtaatttctactaagtgtagatcctcactggcttcagcgattccac

SEQ ID NO: 118 - DNA, 28 bp, Artificial Sequence
  Description of Artificial Sequence: Synthetic oligonucleotide
tttcttcaggaacgaaatctccctccaa

SEQ ID NO: 119 - DNA, 69 bp, Artificial Sequence
  Description of Artificial Sequence: Synthetic oligonucleotide
aattctaatacgactcactataggtaatttctactaagtgtagatttcaggaacgaaatctccctccaa

SEQ ID NO: 120 - DNA, 21 bp, Homo sapiens
ttcttcaggagcgaaatctcc

SEQ ID NO: 121 - DNA, 21 bp, Artificial Sequence
  Description of Artificial Sequence: Synthetic oligonucleotide
ttcttcaggaacgaaatctcc

SEQ ID NO: 122 - DNA, 28 bp, Artificial Sequence
  Description of Artificial Sequence: Synthetic oligonucleotide
ttttcttcaggaacgaaatctccctcca

SEQ ID NO: 123 - DNA, 69 bp, Artificial Sequence
  Description of Artificial Sequence: Synthetic oligonucleotide
aattctaatacgactcactataggtaatttctactaagtgtagatcttcaggaacgaaatctccctcca

SEQ ID NO: 124 - DNA, 28 bp, Artificial Sequence
  Description of Artificial Sequence: Synthetic oligonucleotide
tttcgttcctgaagaaaattcaacagct

SEQ ID NO: 125 - DNA, 69 bp, Artificial Sequence
  Description of Artificial Sequence: Synthetic oligonucleotide
aattctaatacgactcactataggtaatttctactaagtgtagatgttcctgaagaaaattcaacagct

SEQ ID NO: 126 - DNA, 28 bp, Artificial Sequence
  Description of Artificial Sequence: Synthetic oligonucleotide
tttggagggagatttcgttcctgaagaa

SEQ ID NO: 127 - DNA, 69 bp, Artificial Sequence
  Description of Artificial Sequence: Synthetic oligonucleotide
aattctaatacgactcactataggtaatttctactaagtgtagatgagggagatttcgttcctgaagaa

SEQ ID NO: 128 - DNA, 28 bp, Artificial Sequence
  Description of Artificial Sequence: Synthetic oligonucleotide
ttttggagggagatttcgttcctgaaga

SEQ ID NO: 129 - DNA, 69 bp, Artificial Sequence
  Description of Artificial Sequence: Synthetic oligonucleotide
aattctaatacgactcactataggtaatttctactaagtgtagatggagggagatttcgttcctgaaga

SEQ ID NO: 130 - DNA, 28 bp, Artificial Sequence
  Description of Artificial Sequence: Synthetic oligonucleotide
tttcagggaaaggatgcaatctgaatca

SEQ ID NO: 131 - DNA, 69 bp, Artificial Sequence
  Description of Artificial Sequence: Synthetic oligonucleotide
aattctaatacgactcactataggtaatttctactaagtgtagatagggaaaggatgcaatctgaatca

SEQ ID NO: 132 - DNA, 21 bp, Homo sapiens
gattcagattccatcctttcc

SEQ ID NO: 133 - DNA, 21 bp, Artificial Sequence
  Description of Artificial Sequence: Synthetic oligonucleotide
gattcagattgcatcctttcc

SEQ ID NO: 134 - DNA, 28 bp, Artificial Sequence
  Description of Artificial Sequence: Synthetic oligonucleotide
tttgagacacctgggtccattattgtca

SEQ ID NO: 135 - DNA, 69 bp, Artificial Sequence
  Description of Artificial Sequence: Synthetic oligonucleotide
aattctaatacgactcactataggtaatttctactaagtgtagatagacacctgggtccattattgtca

SEQ ID NO: 136 - DNA, 21 bp, Homo sapiens
tgggtccattcttgtcaacac

SEQ ID NO: 137 - DNA, 21 bp, Artificial Sequence
  Description of Artificial Sequence: Synthetic oligonucleotide
tgggtccattattgtcaacac

SEQ ID NO: 138 - DNA, 28 bp, Artificial Sequence
  Description of Artificial Sequence: Synthetic oligonucleotide
ttttgagacacctgggtccattattgtc

SEQ ID NO: 139 - DNA, 69 bp, Artificial Sequence
  Description of Artificial Sequence: Synthetic oligonucleotide
aattctaatacgactcactataggtaatttctactaagtgtagatgagacacctgggtccattattgtc

SEQ ID NO: 140 - DNA, 28 bp, Artificial Sequence
  Description of Artificial Sequence: Synthetic oligonucleotide
tttgggtaggagactgtttgattcctgg

SEQ ID NO: 141 - DNA, 69 bp, Artificial Sequence
  Description of Artificial Sequence: Synthetic oligonucleotide
aattctaatacgactcactataggtaatttctactaagtgtagatggtaggagactgtttgattcctgg

SEQ ID NO: 142 - DNA, 22 bp, Homo sapiens
tcccgcccatccgggtaggaga

SEQ ID NO: 143 - DNA, 22 bp, Artificial Sequence
  Description of Artificial Sequence: Synthetic oligonucleotide
tcccgcccatttgggtaggaga

SEQ ID NO: 144 - DNA, 28 bp, Artificial Sequence
  Description of Artificial Sequence: Synthetic oligonucleotide
tttgctccatgggaacatctttgcctta

SEQ ID NO: 145 - DNA, 69 bp, Artificial Sequence
  Description of Artificial Sequence: Synthetic oligonucleotide
aattctaatacgactcactataggtaatttctactaagtgtagatctccatgggaacatctttgcctta

SEQ ID NO: 146 - DNA, 21 bp, Homo sapiens
tctttgccttgaagcagctga

SEQ ID NO: 147 - DNA, 21 bp, Artificial Sequence
  Description of Artificial Sequence: Synthetic oligonucleotide
tctttgccttaaagcagctga

SEQ ID NO: 148 - DNA, 28 bp, Artificial Sequence
  Description of Artificial Sequence: Synthetic oligonucleotide
tttgccttaaagcagctgagtcactaaa

SEQ ID NO: 149 - DNA, 69 bp, Artificial Sequence
  Description of Artificial Sequence: Synthetic oligonucleotide
aattctaatacgactcactataggtaatttctactaagtgtagatccttaaagcagctgagtcactaaa

SEQ ID NO: 150 - DNA, 28 bp, Artificial Sequence
  Description of Artificial Sequence: Synthetic oligonucleotide
tttagtgactcagctgctttaaggcaaa

SEQ ID NO: 151 - DNA, 69 bp, Artificial Sequence
  Description of Artificial Sequence: Synthetic oligonucleotide
aattctaatacgactcactataggtaatttctactaagtgtagatgtgactcagctgctttaaggcaaa

SEQ ID NO: 152 - DNA, 28 bp, Artificial Sequence
  Description of Artificial Sequence: Synthetic oligonucleotide
tttaaggcaaagatgttcccatggagca

SEQ ID NO: 153 - DNA, 69 bp, Artificial Sequence
  Description of Artificial Sequence: Synthetic oligonucleotide
aattctaatacgactcactataggtaatttctactaagtgtagataggcaaagatgttcccatggagca

SEQ ID NO: 154 - DNA, 28 bp, Artificial Sequence
  Description of Artificial Sequence: Synthetic oligonucleotide
tttctgtgagaaagtactggtgtgaaat

SEQ ID NO: 155 - DNA, 69 bp, Artificial Sequence
  Description of Artificial Sequence: Synthetic oligonucleotide
aattctaatacgactcactataggtaatttctactaagtgtagattgtgagaaagtactggtgtgaaat

SEQ ID NO: 156 - DNA, 21 bp, Homo sapiens
ctgtgagaaaatactggtgtg

SEQ ID NO: 157 - DNA, 21 bp, Artificial Sequence
  Description of Artificial Sequence: Synthetic oligonucleotide
ctgtgagaaagtactggtgtg

SEQ ID NO: 158 - DNA, 28 bp, Artificial Sequence
  Description of Artificial Sequence: Synthetic oligonucleotide
tttcacaccagtactttctcacagaaag

SEQ ID NO: 159 - DNA, 69 bp, Artificial Sequence
  Description of Artificial Sequence: Synthetic oligonucleotide
aattctaatacgactcactataggtaatttctactaagtgtagatacaccagtactttctcacagaaag

SEQ ID NO: 160 - DNA, 28 bp, Artificial Sequence
  Description of Artificial Sequence: Synthetic oligonucleotide
tttcttgaagatttttacaaaaatatat

SEQ ID NO: 161 - DNA, 69 bp, Artificial Sequence
  Description of Artificial Sequence: Synthetic oligonucleotide
aattctaatacgactcactataggtaatttctactaagtgtagatttgaagatttttacaaaaatatat

SEQ ID NO: 162 - DNA, 21 bp, Homo sapiens
gatttttacagaaatatattc

SEQ ID NO: 163 - DNA, 21 bp, Artificial Sequence
  Description of Artificial Sequence: Synthetic oligonucleotide
gatttttacaaaaatatattc

SEQ ID NO: 164 - DNA, 28 bp, Artificial Sequence
  Description of Artificial Sequence: Synthetic oligonucleotide
tttgttttcttgaagatttttacaaaaa

SEQ ID NO: 165 - DNA, 69 bp, Artificial Sequence
  Description of Artificial Sequence: Synthetic oligonucleotide
aattctaatacgactcactataggtaatttctactaagtgtagatttttcttgaagatttttacaaaaa

SEQ ID NO: 166 - DNA, 28 bp, Artificial Sequence
  Description of Artificial Sequence: Synthetic oligonucleotide
tttacaaaaatatattcagaaagaaaca

SEQ ID NO: 167 - DNA, 69 bp, Artificial Sequence
  Description of Artificial Sequence: Synthetic oligonucleotide
aattctaatacgactcactataggtaatttctactaagtgtagatcaaaaatatattcagaaagaaaca

SEQ ID NO: 168 - DNA, 28 bp, Artificial Sequence
  Description of Artificial Sequence: Synthetic oligonucleotide
ttttgttttcttgaagatttttacaaaa

SEQ ID NO: 169 - DNA, 69 bp, Artificial Sequence
  Description of Artificial Sequence: Synthetic oligonucleotide
aattctaatacgactcactataggtaatttctactaagtgtagatgttttcttgaagatttttacaaaa

SEQ ID NO: 170 - DNA, 28 bp, Artificial Sequence
  Description of Artificial Sequence: Synthetic oligonucleotide
ttttcttgaagatttttacaaaaatata

SEQ ID NO: 171 - DNA, 69 bp, Artificial Sequence
  Description of Artificial Sequence: Synthetic oligonucleotide
aattctaatacgactcactataggtaatttctactaagtgtagatcttgaagatttttacaaaaatata

SEQ ID NO: 172 - DNA, 28 bp, Artificial Sequence
  Description of Artificial Sequence: Synthetic oligonucleotide
tttttacaaaaatatattcagaaagaaa

SEQ ID NO: 173 - DNA, 69 bp, Artificial Sequence
  Description of Artificial Sequence: Synthetic oligonucleotide
aattctaatacgactcactataggtaatttctactaagtgtagattacaaaaatatattcagaaagaaa

SEQ ID NO: 174 - DNA, 28 bp, Artificial Sequence
  Description of Artificial Sequence: Synthetic oligonucleotide
ttttacaaaaatatattcagaaagaaac

SEQ ID NO: 175 - DNA, 69 bp, Artificial Sequence
  Description of Artificial Sequence: Synthetic oligonucleotide
aattctaatacgactcactataggtaatttctactaagtgtagatacaaaaatatattcagaaagaaac

SEQ ID NO: 176 - DNA, 28 bp, Artificial Sequence
  Description of Artificial Sequence: Synthetic oligonucleotide
tttctttctgaatatatttttgtaaaaa

SEQ ID NO: 177 - DNA, 69 bp, Artificial Sequence
  Description of Artificial Sequence: Synthetic oligonucleotide
aattctaatacgactcactataggtaatttctactaagtgtagattttctgaatatatttttgtaaaaa

SEQ ID NO: 178 - DNA, 28 bp, Artificial Sequence
  Description of Artificial Sequence: Synthetic oligonucleotide
tttctgaatatatttttgtaaaaatctt

SEQ ID NO: 179 - DNA, 69 bp, Artificial Sequence
  Description of Artificial Sequence: Synthetic oligonucleotide
aattctaatacgactcactataggtaatttctactaagtgtagattgaatatatttttgtaaaaatctt

SEQ ID NO: 180 - DNA, 28 bp, Artificial Sequence
  Description of Artificial Sequence: Synthetic oligonucleotide
tttgtaaaaatcttcaagaaaacaaaat

SEQ ID NO: 181 - DNA, 69 bp, Artificial Sequence
  Description of Artificial Sequence: Synthetic oligonucleotide
aattctaatacgactcactataggtaatttctactaagtgtagattaaaaatcttcaagaaaacaaaat

SEQ ID NO: 182 - DNA, 28 bp, Artificial Sequence
  Description of Artificial Sequence: Synthetic oligonucleotide
tttttgtaaaaatcttcaagaaaacaaa

SEQ ID NO: 183 - DNA, 69 bp, Artificial Sequence
  Description of Artificial Sequence: Synthetic oligonucleotide
aattctaatacgactcactataggtaatttctactaagtgtagattgtaaaaatcttcaagaaaacaaa

SEQ ID NO: 184 - DNA, 28 bp, Artificial Sequence
  Description of Artificial Sequence: Synthetic oligonucleotide
ttttgtaaaaatcttcaagaaaacaaaa

SEQ ID NO: 185 - DNA, 69 bp, Artificial Sequence
  Description of Artificial Sequence: Synthetic oligonucleotide
aattctaatacgactcactataggtaatttctactaagtgtagatgtaaaaatcttcaagaaaacaaaa

SEQ ID NO: 186 - DNA, 28 bp, Artificial Sequence
  Description of Artificial Sequence: Synthetic oligonucleotide
tttgcggccttaaaattaaaaacaacat

SEQ ID NO: 187 - DNA, 69 bp, Artificial Sequence
  Description of Artificial Sequence: Synthetic oligonucleotide
aattctaatacgactcactataggtaatttctactaagtgtagatcggccttaaaattaaaaacaacat

SEQ ID NO: 188 - DNA, 21 bp, Homo sapiens
ttttgcggccctaaaattaaa

SEQ ID NO: 189 - DNA, 21 bp, Artificial Sequence
  Description of Artificial Sequence: Synthetic oligonucleotide
ttttgcggccttaaaattaaa

SEQ ID NO: 190 - DNA, 28 bp, Artificial Sequence
  Description of Artificial Sequence: Synthetic oligonucleotide
ttttgcggccttaaaattaaaaacaaca

SEQ ID NO: 191 - DNA, 69 bp, Artificial Sequence
  Description of Artificial Sequence: Synthetic oligonucleotide
aattctaatacgactcactataggtaatttctactaagtgtagatgcggccttaaaattaaaaacaaca

SEQ ID NO: 192 - DNA, 28 bp, Artificial Sequence
  Description of Artificial Sequence: Synthetic oligonucleotide
tttaattttaaggccgcaaaaggagatt

SEQ ID NO: 193 - DNA, 69 bp, Artificial Sequence
  Description of Artificial Sequence: Synthetic oligonucleotide
aattctaatacgactcactataggtaatttctactaagtgtagatattttaaggccgcaaaaggagatt

SEQ ID NO: 194 - DNA, 28 bp, Artificial Sequence
  Description of Artificial Sequence: Synthetic oligonucleotide
tttaaggccgcaaaaggagatttggtac

SEQ ID NO: 195 - DNA, 69 bp, Artificial Sequence
  Description of Artificial Sequence: Synthetic oligonucleotide
aattctaatacgactcactataggtaatttctactaagtgtagataggccgcaaaaggagatttggtac

SEQ ID NO: 196 - DNA, 28 bp, Artificial Sequence
  Description of Artificial Sequence: Synthetic oligonucleotide
tttttaattttaaggccgcaaaaggaga

SEQ ID NO: 197 - DNA, 69 bp, Artificial Sequence
  Description of Artificial Sequence: Synthetic oligonucleotide
aattctaatacgactcactataggtaatttctactaagtgtagattaattttaaggccgcaaaaggaga

SEQ ID NO: 198 - DNA, 28 bp, Artificial Sequence
  Description of Artificial Sequence: Synthetic oligonucleotide
ttttaattttaaggccgcaaaaggagat

SEQ ID NO: 199 - DNA, 69 bp, Artificial Sequence
  Description of Artificial Sequence: Synthetic oligonucleotide
aattctaatacgactcactataggtaatttctactaagtgtagataattttaaggccgcaaaaggagat

SEQ ID NO: 200 - DNA, 28 bp, Artificial Sequence
  Description of Artificial Sequence: Synthetic oligonucleotide
ttttaaggccgcaaaaggagatttggta

SEQ ID NO: 201 - DNA, 69 bp, Artificial Sequence
  Description of Artificial Sequence: Synthetic oligonucleotide
aattctaatacgactcactataggtaatttctactaagtgtagataaggccgcaaaaggagatttggta

SEQ ID NO: 202 - DNA, 28 bp, Artificial Sequence
  Description of Artificial Sequence: Synthetic oligonucleotide
tttcctgcccaggcatcctcctattttt

SEQ ID NO: 203 - DNA, 69 bp, Artificial Sequence
  Description of Artificial Sequence: Synthetic oligonucleotide
aattctaatacgactcactataggtaatttctactaagtgtagatctgcccaggcatcctcctattttt

SEQ ID NO: 204 - DNA, 21 bp, Homo sapiens
ctgggcaggagaaattctcgg

SEQ ID NO: 205 - DNA, 21 bp, Artificial Sequence
  Description of Artificial Sequence: Synthetic oligonucleotide
ctgggcaggaaaaattctcgg

SEQ ID NO: 206 - DNA, 28 bp, Artificial Sequence
  Description of Artificial Sequence: Synthetic oligonucleotide
tttttcctgcccaggcatcctcctattt

SEQ ID NO: 207 - DNA, 69 bp, Artificial Sequence
  Description of Artificial Sequence: Synthetic oligonucleotide
aattctaatacgactcactataggtaatttctactaagtgtagattcctgcccaggcatcctcctattt

SEQ ID NO: 208 - DNA, 28 bp, Artificial Sequence
  Description of Artificial Sequence: Synthetic oligonucleotide
ttttcctgcccaggcatcctcctatttt

SEQ ID NO: 209 - DNA, 69 bp, Artificial Sequence
  Description of Artificial Sequence: Synthetic oligonucleotide
aattctaatacgactcactataggtaatttctactaagtgtagatcctgcccaggcatcctcctatttt

SEQ ID NO: 210 - DNA, 28 bp, Artificial Sequence
  Description of Artificial Sequence: Synthetic oligonucleotide
tttccaattgcactgactccggccactc

SEQ ID NO: 211 - DNA, 69 bp, Artificial Sequence
  Description of Artificial Sequence: Synthetic oligonucleotide
aattctaatacgactcactataggtaatttctactaagtgtagatcaattgcactgactccggccactc

SEQ ID NO: 212 - DNA, 21 bp, Homo sapiens
tctgcctttctaattgcactg

SEQ ID NO: 213 - DNA, 21 bp, Artificial Sequence
  Description of Artificial Sequence: Synthetic oligonucleotide
tctgcctttccaattgcactg

SEQ ID NO: 214 - DNA, 28 bp, Artificial Sequence
  Description of Artificial Sequence: Synthetic oligonucleotide
tttagagatggttctgcctttccaattg

SEQ ID NO: 215 - DNA, 69 bp, Artificial Sequence
  Description of Artificial Sequence: Synthetic oligonucleotide
aattctaatacgactcactataggtaatttctactaagtgtagatgagatggttctgcctttccaattg

SEQ ID NO: 216 - DNA, 28 bp, Artificial Sequence
  Description of Artificial Sequence: Synthetic oligonucleotide
ttttagagatggttctgcctttccaatt

SEQ ID NO: 217 - DNA, 69 bp, Artificial Sequence
  Description of Artificial Sequence: Synthetic oligonucleotide
aattctaatacgactcactataggtaatttctactaagtgtagatagagatggttctgcctttccaatt

SEQ ID NO: 218 - DNA, 28 bp, Artificial Sequence
  Description of Artificial Sequence: Synthetic oligonucleotide
tttcccagattttcagatgttaagtaga

SEQ ID NO: 219 - DNA, 69 bp, Artificial Sequence
  Description of Artificial Sequence: Synthetic oligonucleotide
aattctaatacgactcactataggtaatttctactaagtgtagatccagattttcagatgttaagtaga

SEQ ID NO: 220 - DNA, 21 bp, Homo sapiens
ctgaaaatcttggaaaagctt

SEQ ID NO: 221 - DNA, 21 bp, Artificial Sequence
  Description of Artificial Sequence: Synthetic oligonucleotide
ctgaaaatctgggaaaagctt

SEQ ID NO: 222 - DNA, 28 bp, Artificial Sequence
  Description of Artificial Sequence: Synthetic oligonucleotide
ttttcccagattttcagatgttaagtag

SEQ ID NO: 223 - DNA, 69 bp, Artificial Sequence
  Description of Artificial Sequence: Synthetic oligonucleotide
aattctaatacgactcactataggtaatttctactaagtgtagatcccagattttcagatgttaagtag

SEQ ID NO: 224 - DNA, 28 bp, Artificial Sequence
  Description of Artificial Sequence: Synthetic oligonucleotide
tttttttgccttcttaatcatctctttg

SEQ ID NO: 225 - DNA, 69 bp, Artificial Sequence
  Description of Artificial Sequence: Synthetic oligonucleotide
aattctaatacgactcactataggtaatttctactaagtgtagattttgccttcttaatcatctctttg

SEQ ID NO: 226 - DNA, 20 bp, Homo sapiens
gtctcaatcattttttgcct

SEQ ID NO: 227 - DNA, 21 bp, Artificial Sequence
  Description of Artificial Sequence: Synthetic oligonucleotide
gtctcaatcatttttttgcct

SEQ ID NO: 228 - DNA, 28 bp, Artificial Sequence
  Description of Artificial Sequence: Synthetic oligonucleotide
tttttttcccctttttcccttttttctt

SEQ ID NO: 229 - DNA, 69 bp, Artificial Sequence
  Description of Artificial Sequence: Synthetic oligonucleotide
aattctaatacgactcactataggtaatttctactaagtgtagattttcccctttttcccttttttctt

SEQ ID NO: 230 - DNA, 20 bp, Homo sapiens
gagctactattttttcccct

SEQ ID NO: 231 - DNA, 21 bp, Artificial Sequence
  Description of Artificial Sequence: Synthetic oligonucleotide
gagctactatttttttcccct

SEQ ID NO: 232 - DNA, 28 bp, Artificial Sequence
  Description of Artificial Sequence: Synthetic oligonucleotide
ttttttcccctttttcccttttttcttc

SEQ ID NO: 233 - DNA, 69 bp, Artificial Sequence
  Description of Artificial Sequence: Synthetic oligonucleotide
aattctaatacgactcactataggtaatttctactaagtgtagatttcccctttttcccttttttcttc

SEQ ID NO: 234 - protein, 50 aa, Artificial Sequence
  Description of Artificial Sequence: Synthetic polypeptide
  MISC_FEATURE (1)..(50): This sequence may encompass 3-50 residues
RRRRRRRRRRRRRRRRRRRRRRRRRRRRRRRRRRRRRRRRRRRRRRRRRR

SEQ ID NO: 235 - DNA, 28 bp, Artificial Sequence
  Description of Artificial Sequence: Synthetic oligonucleotide
tttgggcaacgagacagatcctcatcag

SEQ ID NO: 236 - DNA, 69 bp, Artificial Sequence
  Description of Artificial Sequence: Synthetic oligonucleotide
aattctaatacgactcactataggtaatttctactaagtgtagatggcaacgagacagatcctcatcag

SEQ ID NO: 237 - DNA, 21 bp, Homo sapiens
gatgaggatcggtctcgttgc

SEQ ID NO: 238 - DNA, 21 bp, Artificial Sequence
  Description of Artificial Sequence: Synthetic oligonucleotide
gatgaggatctgtctcgttgc

SEQ ID NO: 239 - DNA, 28 bp, Artificial Sequence
  Description of Artificial Sequence: Synthetic oligonucleotide
tttggccaacaatacacacatttttctg

SEQ ID NO: 240 - DNA, 69 bp, Artificial Sequence
  Description of Artificial Sequence: Synthetic oligonucleotide
aattctaatacgactcactataggtaatttctactaagtgtagatgccaacaatacacacatttttctg

SEQ ID NO: 241 - DNA, 21 bp, Homo sapiens
caatacacacctttttctgat

SEQ ID NO: 242 - DNA, 21 bp, Artificial Sequence
  Description of Artificial Sequence: Synthetic oligonucleotide
caatacacacatttttctgat

SEQ ID NO: 243 - DNA, 28 bp, Artificial Sequence
  Description of Artificial Sequence: Synthetic oligonucleotide
tttccactgcctgtgggactctccaaca

SEQ ID NO: 244 - DNA, 69 bp, Artificial Sequence
  Description of Artificial Sequence: Synthetic oligonucleotide
aattctaatacgactcactataggtaatttctactaagtgtagatcactgcctgtgggactctccaaca

SEQ ID NO: 245 - DNA, 21 bp, Homo sapiens
tttttccacttcctgtgggac

SEQ ID NO: 246 - DNA, 21 bp, Artificial Sequence
  Description of Artificial Sequence: Synthetic oligonucleotide
tttttccactgcctgtgggac

SEQ ID NO: 247 - DNA, 28 bp, Artificial Sequence
  Description of Artificial Sequence: Synthetic oligonucleotide
tttttccactgcctgtgggactctccaa

SEQ ID NO: 248 - DNA, 69 bp, Artificial Sequence
  Description of Artificial Sequence: Synthetic oligonucleotide
aattctaatacgactcactataggtaatttctactaagtgtagattccactgcctgtgggactctccaa

SEQ ID NO: 249 - DNA, 28 bp, Artificial Sequence
  Description of Artificial Sequence: Synthetic oligonucleotide
ttttccactgcctgtgggactctccaac

SEQ ID NO: 250 - DNA, 69 bp, Artificial Sequence
  Description of Artificial Sequence: Synthetic oligonucleotide
aattctaatacgactcactataggtaatttctactaagtgtagatccactgcctgtgggactctccaac

SEQ ID NO: 251 - DNA, 28 bp, Artificial Sequence
  Description of Artificial Sequence: Synthetic oligonucleotide
tttgttggagagtcccacaggcagtgga

SEQ ID NO: 252 - DNA, 69 bp, Artificial Sequence
  Description of Artificial Sequence: Synthetic oligonucleotide
aattctaatacgactcactataggtaatttctactaagtgtagatttggagagtcccacaggcagtgga

SEQ ID NO: 253 - DNA, 28 bp, Artificial Sequence
  Description of Artificial Sequence: Synthetic oligonucleotide
tttcaaaggttgaatggtgcgaatctgc

SEQ ID NO: 254 - DNA, 69 bp, Artificial Sequence
  Description of Artificial Sequence: Synthetic oligonucleotide
aattctaatacgactcactataggtaatttctactaagtgtagataaaggttgaatggtgcgaatctgc

SEQ ID NO: 255 - DNA, 21 bp, Homo sapiens
tgaatggtgctgaatctgctg

SEQ ID NO: 256 - DNA, 20 bp, Artificial Sequence
  Description of Artificial Sequence: Synthetic oligonucleotide
tgaatggtgcgaatctgctg

SEQ ID NO: 257 - DNA, 28 bp, Artificial Sequence
  Description of Artificial Sequence: Synthetic oligonucleotide
tttctaaatgggtacggcagcagattcg

SEQ ID NO: 258 - DNA, 69 bp, Artificial Sequence
  Description of Artificial Sequence: Synthetic oligonucleotide
aattctaatacgactcactataggtaatttctactaagtgtagattaaatgggtacggcagcagattcg

SEQ ID NO: 259 - DNA, 28 bp, Artificial Sequence
  Description of Artificial Sequence: Synthetic oligonucleotide
tttgatcctagagggggtggcagcctgt

SEQ ID NO: 260 - DNA, 69 bp, Artificial Sequence
  Description of Artificial Sequence: Synthetic oligonucleotide
aattctaatacgactcactataggtaatttctactaagtgtagatatcctagagggggtggcagcctgt

SEQ ID NO: 261 - DNA, 21 bp, Homo sapiens
tcctagagggagtggcagcct

SEQ ID NO: 262 - DNA, 21 bp, Artificial Sequence
  Description of Artificial Sequence: Synthetic oligonucleotide
tcctagagggggtggcagcct

SEQ ID NO: 263 - DNA, 28 bp, Artificial Sequence
  Description of Artificial Sequence: Synthetic oligonucleotide
tttcaccgaaggccggaaccagggcagc

SEQ ID NO: 264 - DNA, 69 bp, Artificial Sequence
  Description of Artificial Sequence: Synthetic oligonucleotide
aattctaatacgactcactataggtaatttctactaagtgtagataccgaaggccggaaccagggcagc

SEQ ID NO: 265 - DNA, 21 bp, Homo sapiens
cgaaggccgggaccagggcag

SEQ ID NO: 266 - DNA, 21 bp, Artificial Sequence
  Description of Artificial Sequence: Synthetic oligonucleotide
cgaaggccggaaccagggcag

SEQ ID NO: 267 - DNA, 28 bp, Artificial Sequence
  Description of Artificial Sequence: Synthetic oligonucleotide
tttggaggacaataatatatgtcccaag

SEQ ID NO: 268 - DNA, 69 bp, Artificial Sequence
  Description of Artificial Sequence: Synthetic oligonucleotide
aattctaatacgactcactataggtaatttctactaagtgtagatgaggacaataatatatgtcccaag

SEQ ID NO: 269 - DNA, 21 bp, Homo sapiens
cttgggacatctattattgtc

SEQ ID NO: 270 - DNA, 21 bp, Artificial Sequence
  Description of Artificial Sequence: Synthetic oligonucleotide
cttgggacatatattattgtc

SEQ ID NO: 271 - DNA, 28 bp, Artificial Sequence
  Description of Artificial Sequence: Synthetic oligonucleotide
tttatccaatattatttctacttcttgt

SEQ ID NO: 272 - DNA, 69 bp, Artificial Sequence
  Description of Artificial Sequence: Synthetic oligonucleotide
aattctaatacgactcactataggtaatttctactaagtgtagattccaatattatttctacttcttgt

SEQ ID NO: 273 - DNA, 21 bp, Homo sapiens
atccaatattgtttctacttc

SEQ ID NO: 274 - DNA, 21 bp, Artificial Sequence
  Description of Artificial Sequence: Synthetic oligonucleotide
atccaatattatttctacttc

SEQ ID NO: 275 - DNA, 28 bp, Artificial Sequence
  Description of Artificial Sequence: Synthetic oligonucleotide
tttcagggacaaatgtgctgtgcttaca

SEQ ID NO: 276 - DNA, 69 bp, Artificial Sequence
  Description of Artificial Sequence: Synthetic oligonucleotide
aattctaatacgactcactataggtaatttctactaagtgtagatagggacaaatgtgctgtgcttaca

SEQ ID NO: 277 - DNA, 21 bp, Homo sapiens
tcagggacaattgtgctgtgc

SEQ ID NO: 278 - DNA, 21 bp, Artificial Sequence
  Description of Artificial Sequence: Synthetic oligonucleotide
tcagggacaaatgtgctgtgc

SEQ ID NO: 279 - DNA, 28 bp, Artificial Sequence
  Description of Artificial Sequence: Synthetic oligonucleotide
ttttcagggacaaatgtgctgtgcttac

SEQ ID NO: 280 - DNA, 69 bp, Artificial Sequence
  Description of Artificial Sequence: Synthetic oligonucleotide
aattctaatacgactcactataggtaatttctactaagtgtagatcagggacaaatgtgctgtgcttac

SEQ ID NO: 281 - DNA, 28 bp, Artificial Sequence
  Description of Artificial Sequence: Synthetic oligonucleotide
tttgtccctgaaaatgctgcacatcaag

SEQ ID NO: 282 - DNA, 69 bp, Artificial Sequence
  Description of Artificial Sequence: Synthetic oligonucleotide
aattctaatacgactcactataggtaatttctactaagtgtagattccctgaaaatgctgcacatcaag

SEQ ID NO: 283 - DNA, 28 bp, Artificial Sequence
  Description of Artificial Sequence: Synthetic oligonucleotide
tttgtctgctcaccaagaagttcattca

SEQ ID NO: 284 - DNA, 69 bp, Artificial Sequence
  Description of Artificial Sequence: Synthetic oligonucleotide
aattctaatacgactcactataggtaatttctactaagtgtagattctgctcaccaagaagttcattca

SEQ ID NO: 285 - DNA, 21 bp, Homo sapiens
tacgtctcttggtctgctcac

SEQ ID NO: 286 - DNA, 21 bp, Artificial Sequence
  Description of Artificial Sequence: Synthetic oligonucleotide
tacgtctctttgtctgctcac

SEQ ID NO: 287 - DNA, 28 bp, Artificial Sequence
  Description of Artificial Sequence: Synthetic oligonucleotide
tttgggcgggccaaactgctgggtgcgg

SEQ ID NO: 288 - DNA, 69 bp, Artificial Sequence
  Description of Artificial Sequence: Synthetic oligonucleotide
aattctaatacgactcactataggtaatttctactaagtgtagatggcgggccaaactgctgggtgcgg

SEQ ID NO: 289 - DNA, 21 bp, Homo sapiens
gattttgggctggccaaactg

SEQ ID NO: 290 - DNA, 21 bp, Artificial Sequence
  Description of Artificial Sequence: Synthetic oligonucleotide
gattttgggcgggccaaactg

SEQ ID NO: 291 - DNA, 28 bp, Artificial Sequence
  Description of Artificial Sequence: Synthetic oligonucleotide
ttttgggcgggccaaactgctgggtgcg

SEQ ID NO: 292 - DNA, 69 bp, Artificial Sequence
  Description of Artificial Sequence: Synthetic oligonucleotide
aattctaatacgactcactataggtaatttctactaagtgtagatgggcgggccaaactgctgggtgcg

SEQ ID NO: 293 - DNA, 28 bp, Artificial Sequence
  Description of Artificial Sequence: Synthetic oligonucleotide
tttggcccgcccaaaatctgtgatcttg

SEQ ID NO: 294 - DNA, 69 bp, Artificial Sequence
  Description of Artificial Sequence: Synthetic oligonucleotide
aattctaatacgactcactataggtaatttctactaagtgtagatgcccgcccaaaatctgtgatcttg

SEQ ID NO: 295 - DNA, 28 bp, Artificial Sequence
  Description of Artificial Sequence: Synthetic oligonucleotide
tttccttgttggctttcggagatgtttt

SEQ ID NO: 296 - DNA, 69 bp, Artificial Sequence
  Description of Artificial Sequence: Synthetic oligonucleotide
aattctaatacgactcactataggtaatttctactaagtgtagatcttgttggctttcggagatgtttt

SEQ ID NO: 297 - DNA, 28 bp, Artificial Sequence
  Description of Artificial Sequence: Synthetic oligonucleotide
tttcggagatgttttgatagcgacggga

SEQ ID NO: 298 - DNA, 69 bp, Artificial Sequence
  Description of Artificial Sequence: Synthetic oligonucleotide
aattctaatacgactcactataggtaatttctactaagtgtagatggagatgttttgatagcgacggga

SEQ ID NO: 299 - DNA, 28 bp, Artificial Sequence
  Description of Artificial Sequence: Synthetic oligonucleotide
ttttgatagcgacgggaattttaacttt

SEQ ID NO: 300 - DNA, 69 bp, Artificial Sequence
  Description of Artificial Sequence: Synthetic oligonucleotide
aattctaatacgactcactataggtaatttctactaagtgtagatgatagcgacgggaattttaacttt

SEQ ID NO: 301 - DNA, 28 bp, Artificial Sequence
  Description of Artificial Sequence: Synthetic oligonucleotide
tttccttgttggctttcggagatgtctt

SEQ ID NO: 302 - DNA, 69 bp, Artificial Sequence
  Description of Artificial Sequence: Synthetic oligonucleotide
aattctaatacgactcactataggtaatttctactaagtgtagatcttgttggctttcggagatgtctt

SEQ ID NO: 303 - DNA, 28 bp, Artificial Sequence
  Description of Artificial Sequence: Synthetic oligonucleotide
tttcggagatgtcttgatagcgacggga

SEQ ID NO: 304 - DNA, 69 bp, Artificial Sequence
  Description of Artificial Sequence: Synthetic oligonucleotide
aattctaatacgactcactataggtaatttctactaagtgtagatggagatgtcttgatagcgacggga

SEQ ID NO: 305 - DNA, 28 bp, Artificial Sequence
  Description of Artificial Sequence: Synthetic oligonucleotide
tttaaattctttacagtgcacttcaaaa

SEQ ID NO: 306 - DNA, 69 bp, Artificial Sequence
  Description of Artificial Sequence: Synthetic oligonucleotide
aattctaatacgactcactataggtaatttctactaagtgtagataattctttacagtgcacttcaaaa

SEQ ID NO: 307 - DNA, 21 bp, Homo sapiens
gtgcacttcagaaggagatca

SEQ ID NO: 308 - DNA, 21 bp, Artificial Sequence
  Description of Artificial Sequence: Synthetic oligonucleotide
gtgcacttcaaaaggagatca

SEQ ID NO: 309 - DNA, 28 bp, Artificial Sequence
  Description of Artificial Sequence: Synthetic oligonucleotide
tttacagtgcacttcaaaaggagatcac

SEQ ID NO: 310 - DNA, 69 bp, Artificial Sequence
  Description of Artificial Sequence: Synthetic oligonucleotide
aattctaatacgactcactataggtaatttctactaagtgtagatcagtgcacttcaaaaggagatcac

SEQ ID NO: 311 - DNA, 28 bp, Artificial Sequence
  Description of Artificial Sequence: Synthetic oligonucleotide
ttttaaattctttacagtgcacttcaaa

SEQ ID NO: 312 - DNA, 69 bp, Artificial Sequence
  Description of Artificial Sequence: Synthetic oligonucleotide
aattctaatacgactcactataggtaatttctactaagtgtagataaattctttacagtgcacttcaaa

SEQ ID NO: 313 - DNA, 28 bp, Artificial Sequence
  Description of Artificial Sequence: Synthetic oligonucleotide
tttgaagtgcactgtaaagaatttaaaa

SEQ ID NO: 314 - DNA, 69 bp, Artificial Sequence
  Description of Artificial Sequence: Synthetic oligonucleotide
aattctaatacgactcactataggtaatttctactaagtgtagataagtgcactgtaaagaatttaaaa

SEQ ID NO: 315 - DNA, 28 bp, Artificial Sequence
  Description of Artificial Sequence: Synthetic oligonucleotide
ttttgaagtgcactgtaaagaatttaaa

SEQ ID NO: 316 - DNA, 69 bp, Artificial Sequence
  Description of Artificial Sequence: Synthetic oligonucleotide
aattctaatacgactcactataggtaatttctactaagtgtagatgaagtgcactgtaaagaatttaaa

SEQ ID NO: 317 - DNA, 28 bp, Artificial Sequence
  Description of Artificial Sequence: Synthetic oligonucleotide
tttctgatttcgaactttcgcgtgtcct

SEQ ID NO: 318 - DNA, 69 bp, Artificial Sequence
  Description of Artificial Sequence: Synthetic oligonucleotide
aattctaatacgactcactataggtaatttctactaagtgtagattgatttcgaactttcgcgtgtcct

SEQ ID NO: 319 - DNA, 21 bp, Homo sapiens
tctgatttcggactttcgcgt

SEQ ID NO: 320 - DNA, 21 bp, Artificial Sequence
  Description of Artificial Sequence: Synthetic oligonucleotide
tctgatttcgaactttcgcgt

SEQ ID NO: 321 - DNA, 28 bp, Artificial Sequence
  Description of Artificial Sequence: Synthetic oligonucleotide
tttcgaactttcgcgtgtcctggaggat

SEQ ID NO: 322 - DNA, 69 bp, Artificial Sequence
  Description of Artificial Sequence: Synthetic oligonucleotide
aattctaatacgactcactataggtaatttctactaagtgtagatgaactttcgcgtgtcctggaggat

SEQ ID NO: 323 - DNA, 28 bp, Artificial Sequence
  Description of Artificial Sequence: Synthetic oligonucleotide
tttgcacacaaggttactgttgtttaag

SEQ ID NO: 324 - DNA, 69 bp, Artificial Sequence
  Description of Artificial Sequence: Synthetic oligonucleotide
aattctaatacgactcactataggtaatttctactaagtgtagatcacacaaggttactgttgtttaag

SEQ ID NO: 325 - DNA, 21 bp, Homo sapiens
gttactgttgattaagatgtt

SEQ ID NO: 326 - DNA, 21 bp, Artificial Sequence
  Description of Artificial Sequence: Synthetic oligonucleotide
gttactgttgtttaagatgtt

SEQ ID NO: 327 - DNA, 28 bp, Artificial Sequence
  Description of Artificial Sequence: Synthetic oligonucleotide
tttaagatgtttctggcagcaagatctc

SEQ ID NO: 328 - DNA, 69 bp, Artificial Sequence
  Description of Artificial Sequence: Synthetic oligonucleotide
aattctaatacgactcactataggtaatttctactaagtgtagatagatgtttctggcagcaagatctc

SEQ ID NO: 329 - DNA, 28 bp, Artificial Sequence
  Description of Artificial Sequence: Synthetic oligonucleotide
tttcataacaccgtcaccaagatcaagt

SEQ ID NO: 330 - DNA, 69 bp, Artificial Sequence
  Description of Artificial Sequence: Synthetic oligonucleotide
aattctaatacgactcactataggtaatttctactaagtgtagatataacaccgtcaccaagatcaagt

SEQ ID NO: 331 - DNA, 21 bp, Homo sapiens
ttcataacacggtcaccaaga

SEQ ID NO: 332 - DNA, 21 bp, Artificial Sequence
  Description of Artificial Sequence: Synthetic oligonucleotide
ttcataacaccgtcaccaaga

SEQ ID NO: 333 - DNA, 28 bp, Artificial Sequence
  Description of Artificial Sequence: Synthetic oligonucleotide
tttacagaacttgatcttggtgacggtg

SEQ ID NO: 334 - DNA, 69 bp, Artificial Sequence
  Description of Artificial Sequence: Synthetic oligonucleotide
aattctaatacgactcactataggtaatttctactaagtgtagatcagaacttgatcttggtgacggtg

SEQ ID NO: 335 - DNA, 28 bp, Artificial Sequence
  Description of Artificial Sequence: Synthetic oligonucleotide
tttttttttctgtgtaaccaactttcag

SEQ ID NO: 336 - DNA, 69 bp, Artificial Sequence
  Description of Artificial Sequence: Synthetic oligonucleotide
aattctaatacgactcactataggtaatttctactaagtgtagattttttctgtgtaaccaactttcag

SEQ ID NO: 337 - DNA, 21 bp, Homo sapiens
tctctcctttgtttttctgtg

SEQ ID NO: 338 - DNA, 21 bp, Artificial Sequence
  Description of Artificial Sequence: Synthetic oligonucleotide
tctctcctttttttttctgtg

SEQ ID NO: 339 - DNA, 28 bp, Artificial Sequence
  Description of Artificial Sequence: Synthetic oligonucleotide
ttttttttctgtgtaaccaactttcagg

SEQ ID NO: 340 - DNA, 69 bp, Artificial Sequence
  Description of Artificial Sequence: Synthetic oligonucleotide
aattctaatacgactcactataggtaatttctactaagtgtagatttttctgtgtaaccaactttcagg

SEQ ID NO: 341 - DNA, 28 bp, Artificial Sequence
  Description of Artificial Sequence: Synthetic oligonucleotide
tttttttctgtgtaaccaactttcaggg

SEQ ID NO: 342 - DNA, 69 bp, Artificial Sequence
  Description of Artificial Sequence: Synthetic oligonucleotide
aattctaatacgactcactataggtaatttctactaagtgtagattttctgtgtaaccaactttcaggg

SEQ ID NO: 343 - DNA, 28 bp, Artificial Sequence
  Description of Artificial Sequence: Synthetic oligonucleotide
ttttttctgtgtaaccaactttcagggt

SEQ ID NO: 344 - DNA, 69 bp, Artificial Sequence
  Description of Artificial Sequence: Synthetic oligonucleotide
aattctaatacgactcactataggtaatttctactaagtgtagatttctgtgtaaccaactttcagggt

SEQ ID NO: 345 - DNA, 28 bp, Artificial Sequence
  Description of Artificial Sequence: Synthetic oligonucleotide
tttcatctgcagcaatggtgtttatttt

SEQ ID NO: 346 - DNA, 69 bp, Artificial Sequence
  Description of Artificial Sequence: Synthetic oligonucleotide
aattctaatacgactcactataggtaatttctactaagtgtagatatctgcagcaatggtgtttatttt

SEQ ID NO: 347 - DNA, 21 bp, Homo sapiens
gcaatggtgtctatttttaca

SEQ ID NO: 348 - DNA, 21 bp, Artificial Sequence
  Description of Artificial Sequence: Synthetic oligonucleotide
gcaatggtgtttatttttaca

SEQ ID NO: 349 - DNA, 28 bp, Artificial Sequence
  Description of Artificial Sequence: Synthetic oligonucleotide
tttatttttacatagaggttttctctta

SEQ ID NO: 350 - DNA, 69 bp, Artificial Sequence
  Description of Artificial Sequence: Synthetic oligonucleotide
aattctaatacgactcactataggtaatttctactaagtgtagattttttacatagaggttttctctta

SEQ ID NO: 351 - DNA, 28 bp, Artificial Sequence
  Description of Artificial Sequence: Synthetic oligonucleotide
tttcttttgatgaccaaccattgtgatc

SEQ ID NO: 352 - DNA, 69 bp, Artificial Sequence
  Description of Artificial Sequence: Synthetic oligonucleotide
aattctaatacgactcactataggtaatttctactaagtgtagatttttgatgaccaaccattgtgatc

SEQ ID NO: 353 - DNA, 21 bp, Homo sapiens
tgaccaaccagtgtgatccct

SEQ ID NO: 354 - DNA, 21 bp, Artificial Sequence
  Description of Artificial Sequence: Synthetic oligonucleotide
tgaccaaccattgtgatccct

SEQ ID NO: 355 - DNA, 28 bp, Artificial Sequence
  Description of Artificial Sequence: Synthetic oligonucleotide
tttgatgaccaaccattgtgatccctaa

SEQ ID NO: 356 - DNA, 69 bp, Artificial Sequence
  Description of Artificial Sequence: Synthetic oligonucleotide
aattctaatacgactcactataggtaatttctactaagtgtagatatgaccaaccattgtgatccctaa

SEQ ID NO: 357 - DNA, 28 bp, Artificial Sequence
  Description of Artificial Sequence: Synthetic oligonucleotide
ttttcttttgatgaccaaccattgtgat

SEQ ID NO: 358 - DNA, 69 bp, Artificial Sequence
  Description of Artificial Sequence: Synthetic oligonucleotide
aattctaatacgactcactataggtaatttctactaagtgtagatcttttgatgaccaaccattgtgat

SEQ ID NO: 359 - DNA, 28 bp, Artificial Sequence
  Description of Artificial Sequence: Synthetic oligonucleotide
ttttgatgaccaaccattgtgatcccta

SEQ ID NO: 360 - DNA, 69 bp, Artificial Sequence
  Description of Artificial Sequence: Synthetic oligonucleotide
aattctaatacgactcactataggtaatttctactaagtgtagatgatgaccaaccattgtgatcccta

SEQ ID NO: 361 - DNA, 28 bp, Artificial Sequence
  Description of Artificial Sequence: Synthetic oligonucleotide
tttagggatcacaatggttggtcatcaa

SEQ ID NO: 362 - DNA, 69 bp, Artificial Sequence
  Description of Artificial Sequence: Synthetic oligonucleotide
aattctaatacgactcactataggtaatttctactaagtgtagatgggatcacaatggttggtcatcaa

SEQ ID NO: 363 - DNA, 28 bp, Artificial Sequence
  Description of Artificial Sequence: Synthetic oligonucleotide
tttgggagcagggcgaatgtgttccctg

SEQ ID NO: 364 - DNA, 69 bp, Artificial Sequence
  Description of Artificial Sequence: Synthetic oligonucleotide
aattctaatacgactcactataggtaatttctactaagtgtagatggagcagggcgaatgtgttccctg

SEQ ID NO: 365 - DNA, 21 bp, Homo sapiens
ctgctcccaactgcaccgctt

SEQ ID NO: 366 - DNA, 21 bp, Artificial Sequence
  Description of Artificial Sequence: Synthetic oligonucleotide
ctgctcccaaatgcaccgctt

SEQ ID NO: 367 - DNA, 28 bp, Artificial Sequence
  Description of Artificial Sequence: Synthetic oligonucleotide
tttgttgtgctttagaatccagcagtaa

SEQ ID NO: 368 - DNA, 69 bp, Artificial Sequence
  Description of Artificial Sequence: Synthetic oligonucleotide
aattctaatacgactcactataggtaatttctactaagtgtagatttgtgctttagaatccagcagtaa

SEQ ID NO: 369 - DNA, 21 bp, Homo sapiens
tccagcagtagtactgaaaaa

SEQ ID NO: 370 - DNA, 21 bp, Artificial Sequence
  Description of Artificial Sequence: Synthetic oligonucleotide
tccagcagtaatactgaaaaa

SEQ ID NO: 371 - DNA, 28 bp, Artificial Sequence
  Description of Artificial Sequence: Synthetic oligonucleotide
tttagaatccagcagtaatactgaaaaa

SEQ ID NO: 372 - DNA, 69 bp, Artificial Sequence
  Description of Artificial Sequence: Synthetic oligonucleotide
aattctaatacgactcactataggtaatttctactaagtgtagatgaatccagcagtaatactgaaaaa

SEQ ID NO: 373 - DNA, 28 bp, Artificial Sequence
  Description of Artificial Sequence: Synthetic oligonucleotide
tttctttttcagtattactgctggattc

SEQ ID NO: 374 - DNA, 69 bp, Artificial Sequence
  Description of Artificial Sequence: Synthetic oligonucleotide
aattctaatacgactcactataggtaatttctactaagtgtagattttttcagtattactgctggattc

SEQ ID NO: 375 - DNA, 28 bp, Artificial Sequence
  Description of Artificial Sequence: Synthetic oligonucleotide
tttcagtattactgctggattctaaagc

SEQ ID NO: 376 - DNA, 69 bp, Artificial Sequence
  Description of Artificial Sequence: Synthetic oligonucleotide
aattctaatacgactcactataggtaatttctactaagtgtagatagtattactgctggattctaaagc

SEQ ID NO: 377 - DNA, 28 bp, Artificial Sequence
  Description of Artificial Sequence: Synthetic oligonucleotide
tttttcagtattactgctggattctaaa

SEQ ID NO: 378 - DNA, 69 bp, Artificial Sequence
  Description of Artificial Sequence: Synthetic oligonucleotide
aattctaatacgactcactataggtaatttctactaagtgtagattcagtattactgctggattctaaa

SEQ ID NO: 379 - DNA, 28 bp, Artificial Sequence
  Description of Artificial Sequence: Synthetic oligonucleotide
ttttcagtattactgctggattctaaag

SEQ ID NO: 380 - DNA, 69 bp, Artificial Sequence
  Description of Artificial Sequence: Synthetic oligonucleotide
aattctaatacgactcactataggtaatttctactaagtgtagatcagtattactgctggattctaaag

SEQ ID NO: 381 - DNA, 28 bp, Artificial Sequence
  Description of Artificial Sequence: Synthetic oligonucleotide
tttcagactatttggtttcgaatcattt

SEQ ID NO: 382 - DNA, 69 bp, Artificial Sequence
  Description of Artificial Sequence: Synthetic oligonucleotide
aattctaatacgactcactataggtaatttctactaagtgtagatagactatttggtttcgaatcattt

SEQ ID NO: 383 - DNA, 21 bp, Homo sapiens
cagactatttgggtttcgaat

SEQ ID NO: 384 - DNA, 20 bp, Artificial Sequence
  Description of Artificial Sequence: Synthetic oligonucleotide
cagactatttggtttcgaat

SEQ ID NO: 385 - DNA, 28 bp, Artificial Sequence
  Description of Artificial Sequence: Synthetic oligonucleotide
tttggtttcgaatcattttgtctagaat

SEQ ID NO: 386 - DNA, 69 bp, Artificial Sequence
  Description of Artificial Sequence: Synthetic oligonucleotide
aattctaatacgactcactataggtaatttctactaagtgtagatgtttcgaatcattttgtctagaat

SEQ ID NO: 387 - DNA, 28 bp, Artificial Sequence
  Description of Artificial Sequence: Synthetic oligonucleotide
ttttcagactatttggtttcgaatcatt

SEQ ID NO: 388 - DNA, 69 bp, Artificial Sequence
  Description of Artificial Sequence: Synthetic oligonucleotide
aattctaatacgactcactataggtaatttctactaagtgtagatcagactatttggtttcgaatcatt

SEQ ID NO: 389 - DNA, 28 bp, Artificial Sequence
  Description of Artificial Sequence: Synthetic oligonucleotide
tttgcagcctgtaagggaacaggctctg

SEQ ID NO: 390 - DNA, 69 bp, Artificial Sequence
  Description of Artificial Sequence: Synthetic oligonucleotide
aattctaatacgactcactataggtaatttctactaagtgtagatcagcctgtaagggaacaggctctg

SEQ ID NO: 391 - DNA, 21 bp, Homo sapiens
tgcagcctgtgagggaacagg

SEQ ID NO: 392 - DNA, 21 bp, Artificial Sequence
  Description of Artificial Sequence: Synthetic oligonucleotide
tgcagcctgtaagggaacagg

SEQ ID NO: 393 - DNA, 28 bp, Artificial Sequence
  Description of Artificial Sequence: Synthetic oligonucleotide
tttccagttggaacccaatccccacacc

SEQ ID NO: 394 - DNA, 69 bp, Artificial Sequence
  Description of Artificial Sequence: Synthetic oligonucleotide
aattctaatacgactcactataggtaatttctactaagtgtagatcagttggaacccaatccccacacc

SEQ ID NO: 395 - DNA, 21 bp, Homo sapiens
aactttccagctggaacccaa

SEQ ID NO: 396 - DNA, 21 bp, Artificial Sequence
  Description of Artificial Sequence: Synthetic oligonucleotide
aactttccagttggaacccaa

SEQ ID NO: 397 - DNA, 28 bp, Artificial Sequence
  Description of Artificial Sequence: Synthetic oligonucleotide
tttgggattggaccggaataagttaata

SEQ ID NO: 398 - DNA, 69 bp, Artificial Sequence
  Description of Artificial Sequence: Synthetic oligonucleotide
aattctaatacgactcactataggtaatttctactaagtgtagatggattggaccggaataagttaata

SEQ ID NO: 399 - DNA, 21 bp, Homo sapiens
gttactctttaggattggacc

SEQ ID NO: 400 - DNA, 21 bp, Artificial Sequence
  Description of Artificial Sequence: Synthetic oligonucleotide
gttactctttgggattggacc

SEQ ID NO: 401 - DNA, 28 bp, Artificial Sequence
  Description of Artificial Sequence: Synthetic oligonucleotide
tttattaacttattccggtccaatccca

SEQ ID NO: 402 - DNA, 69 bp, Artificial Sequence
  Description of Artificial Sequence: Synthetic oligonucleotide
aattctaatacgactcactataggtaatttctactaagtgtagatttaacttattccggtccaatccca

SEQ ID NO: 403 - DNA, 28 bp, Artificial Sequence
  Description of Artificial Sequence: Synthetic oligonucleotide
tttccccccactcaatagcgtgtctccg

SEQ ID NO: 404 - DNA, 69 bp, Artificial Sequence
  Description of Artificial Sequence: Synthetic oligonucleotide
aattctaatacgactcactataggtaatttctactaagtgtagatcccccactcaatagcgtgtctccg

SEQ ID NO: 405 - DNA, 21 bp, Homo sapiens
ccccactcaacagcgtgtctc

SEQ ID NO: 406 - DNA, 21 bp, Artificial Sequence
  Description of Artificial Sequence: Synthetic oligonucleotide
ccccactcaatagcgtgtctc

SEQ ID NO: 407 - DNA, 28 bp, Artificial Sequence
  Description of Artificial Sequence: Synthetic oligonucleotide
tttgtaccagactatcaggctgaaagta

SEQ ID NO: 408 - DNA, 69 bp, Artificial Sequence
  Description of Artificial Sequence: Synthetic oligonucleotide
aattctaatacgactcactataggtaatttctactaagtgtagattaccagactatcaggctgaaagta

SEQ ID NO: 409 - DNA, 21 bp, Homo sapiens
ctatacttacaactttcagcc

SEQ ID NO: 410 - DNA, 21 bp, Artificial Sequence
  Description of Artificial Sequence: Synthetic oligonucleotide
ctatacttactactttcagcc

SEQ ID NO: 411 - DNA, 28 bp, Artificial Sequence
  Description of Artificial Sequence: Synthetic oligonucleotide
tttcaaggcttcatacatcttccctagg

SEQ ID NO: 412 - DNA, 69 bp, Artificial Sequence
  Description of Artificial Sequence: Synthetic oligonucleotide
aattctaatacgactcactataggtaatttctactaagtgtagataaggcttcatacatcttccctagg

SEQ ID NO: 413 - DNA, 21 bp, Homo sapiens
tacatcttccttaggaactcc

SEQ ID NO: 414 - DNA, 21 bp, Artificial Sequence
  Description of Artificial Sequence: Synthetic oligonucleotide
tacatcttccctaggaactcc

SEQ ID NO: 415 - DNA, 28 bp, Artificial Sequence
  Description of Artificial Sequence: Synthetic oligonucleotide
tttctgcatttgcttcaatatcacgact

SEQ ID NO: 416 - DNA, 69 bp, Artificial Sequence
  Description of Artificial Sequence: Synthetic oligonucleotide
aattctaatacgactcactataggtaatttctactaagtgtagattgcatttgcttcaatatcacgact

SEQ ID NO: 417 - DNA, 21 bp, Homo sapiens
cttcaatatcccgacttgctg

SEQ ID NO: 418 - DNA, 21 bp, Artificial Sequence
  Description of Artificial Sequence: Synthetic oligonucleotide
cttcaatatcacgacttgctg

SEQ ID NO: 419 - DNA, 28 bp, Artificial Sequence
  Description of Artificial Sequence: Synthetic oligonucleotide
tttgcttcaatatcacgacttgctgcat

SEQ ID NO: 420 - DNA, 69 bp, Artificial Sequence
  Description of Artificial Sequence: Synthetic oligonucleotide
aattctaatacgactcactataggtaatttctactaagtgtagatcttcaatatcacgacttgctgcat

SEQ ID NO: 421 - DNA, 28 bp, Artificial Sequence
  Description of Artificial Sequence: Synthetic oligonucleotide
tttgtgtttgaggctctgatccgtcaca

SEQ ID NO: 422 - DNA, 69 bp, Artificial Sequence
  Description of Artificial Sequence: Synthetic oligonucleotide
aattctaatacgactcactataggtaatttctactaagtgtagattgtttgaggctctgatccgtcaca

SEQ ID NO: 423 - DNA, 21 bp, Homo sapiens
ctctgatccgccacacaactc

SEQ ID NO: 424 - DNA, 21 bp, Artificial Sequence
  Description of Artificial Sequence: Synthetic oligonucleotide
ctctgatccgtcacacaactc

SEQ ID NO: 425 - DNA, 28 bp, Artificial Sequence
  Description of Artificial Sequence: Synthetic oligonucleotide
tttgaggctctgatccgtcacacaactc

SEQ ID NO: 426 - DNA, 69 bp, Artificial Sequence
  Description of Artificial Sequence: Synthetic oligonucleotide
aattctaatacgactcactataggtaatttctactaagtgtagataggctctgatccgtcacacaactc

SEQ ID NO: 427 - DNA, 28 bp, Artificial Sequence
  Description of Artificial Sequence: Synthetic oligonucleotide
tttgctgccttgtcatacactgaagaaa

SEQ ID NO: 428 - DNA, 69 bp, Artificial Sequence
  Description of Artificial Sequence: Synthetic oligonucleotide
aattctaatacgactcactataggtaatttctactaagtgtagatctgccttgtcatacactgaagaaa

SEQ ID NO: 429 - DNA, 21 bp, Homo sapiens
cttgtcataccctgaagaaaa

SEQ ID NO: 430 - DNA, 21 bp, Artificial Sequence
  Description of Artificial Sequence: Synthetic oligonucleotide
cttgtcatacactgaagaaaa

SEQ ID NO: 431 - DNA, 28 bp, Artificial Sequence
  Description of Artificial Sequence: Synthetic oligonucleotide
tttcttcagtgtatgacaaggcagcaaa

SEQ ID NO: 432 - DNA, 69 bp, Artificial Sequence
  Description of Artificial Sequence: Synthetic oligonucleotide
aattctaatacgactcactataggtaatttctactaagtgtagatttcagtgtatgacaaggcagcaaa

SEQ ID NO: 433 - DNA, 28 bp, Artificial Sequence
  Description of Artificial Sequence: Synthetic oligonucleotide
tttattttttcttcagtgtatgacaagg

SEQ ID NO: 434 - DNA, 69 bp, Artificial Sequence
  Description of Artificial Sequence: Synthetic oligonucleotide
aattctaatacgactcactataggtaatttctactaagtgtagatttttttcttcagtgtatgacaagg

SEQ ID NO: 435 - DNA, 28 bp, Artificial Sequence
  Description of Artificial Sequence: Synthetic oligonucleotide
tttttattttttcttcagtgtatgacaa

SEQ ID NO: 436 - DNA, 69 bp, Artificial Sequence
  Description of Artificial Sequence: Synthetic oligonucleotide
aattctaatacgactcactataggtaatttctactaagtgtagattattttttcttcagtgtatgacaa

SEQ ID NO: 437 - DNA, 28 bp, Artificial Sequence
  Description of Artificial Sequence: Synthetic oligonucleotide
ttttattttttcttcagtgtatgacaag

SEQ ID NO: 438 - DNA, 69 bp, Artificial Sequence
  Description of Artificial Sequence: Synthetic oligonucleotide
aattctaatacgactcactataggtaatttctactaagtgtagatattttttcttcagtgtatgacaag

SEQ ID NO: 439 - DNA, 28 bp, Artificial Sequence
  Description of Artificial Sequence: Synthetic oligonucleotide
ttttttcttcagtgtatgacaaggcagc

SEQ ID NO: 440 - DNA, 69 bp, Artificial Sequence
  Description of Artificial Sequence: Synthetic oligonucleotide
aattctaatacgactcactataggtaatttctactaagtgtagatttcttcagtgtatgacaaggcagc

SEQ ID NO: 441 - DNA, 28 bp, Artificial Sequence
  Description of Artificial Sequence: Synthetic oligonucleotide
tttttcttcagtgtatgacaaggcagca

SEQ ID NO: 442 - DNA, 69 bp, Artificial Sequence
  Description of Artificial Sequence: Synthetic oligonucleotide
aattctaatacgactcactataggtaatttctactaagtgtagattcttcagtgtatgacaaggcagca

SEQ ID NO: 443 - DNA, 28 bp, Artificial Sequence
  Description of Artificial Sequence: Synthetic oligonucleotide
ttttcttcagtgtatgacaaggcagcaa

SEQ ID NO: 444 - DNA, 69 bp, Artificial Sequence
  Description of Artificial Sequence: Synthetic oligonucleotide
aattctaatacgactcactataggtaatttctactaagtgtagatcttcagtgtatgacaaggcagcaa

SEQ ID NO: 445 - DNA, 28 bp, Artificial Sequence
  Description of Artificial Sequence: Synthetic oligonucleotide
tttatcttcttgaaagccggagctcgca

SEQ ID NO: 446 - DNA, 69 bp, Artificial Sequence
  Description of Artificial Sequence: Synthetic oligonucleotide
aattctaatacgactcactataggtaatttctactaagtgtagattcttcttgaaagccggagctcgca

SEQ ID NO: 447 - DNA, 21 bp, Homo sapiens
ttttatcttcctgaaagccgg

SEQ ID NO: 448 - DNA, 21 bp, Artificial Sequence
  Description of Artificial Sequence: Synthetic oligonucleotide
ttttatcttcttgaaagccgg

SEQ ID NO: 449 - DNA, 28 bp, Artificial Sequence
  Description of Artificial Sequence: Synthetic oligonucleotide
ttttatcttcttgaaagccggagctcgc

SEQ ID NO: 450 - DNA, 69 bp, Artificial Sequence
  Description of Artificial Sequence: Synthetic oligonucleotide
aattctaatacgactcactataggtaatttctactaagtgtagatatcttcttgaaagccggagctcgc

SEQ ID NO: 451 - DNA, 28 bp, Artificial Sequence
  Description of Artificial Sequence: Synthetic oligonucleotide
tttcaagaagataaaagtctgagtgatg

SEQ ID NO: 452 - DNA, 69 bp, Artificial Sequence
  Description of Artificial Sequence: Synthetic oligonucleotide
aattctaatacgactcactataggtaatttctactaagtgtagataagaagataaaagtctgagtgatg

SEQ ID NO: 453 - DNA, 28 bp, Artificial Sequence
  Description of Artificial Sequence: Synthetic oligonucleotide
tttgcgagctccggctttcaagaagata

SEQ ID NO: 454 - DNA, 69 bp, Artificial Sequence
  Description of Artificial Sequence: Synthetic oligonucleotide
aattctaatacgactcactataggtaatttctactaagtgtagatcgagctccggctttcaagaagata

SEQ ID NO: 455 - DNA, 28 bp, Artificial Sequence
  Description of Artificial Sequence: Synthetic oligonucleotide
ttttcttgccactgatgatacaaaagca

SEQ ID NO: 456 - DNA, 69 bp, Artificial Sequence
  Description of Artificial Sequence: Synthetic oligonucleotide
aattctaatacgactcactataggtaatttctactaagtgtagatcttgccactgatgatacaaaagca

SEQ ID NO: 457 - DNA, 21 bp, Homo sapiens
atccggtgtcgtttcttgcca

SEQ ID NO: 458 - DNA, 21 bp, Artificial Sequence
  Description of Artificial Sequence: Synthetic oligonucleotide
atccggtgtcttttcttgcca

SEQ ID NO: 459 - DNA, 28 bp, Artificial Sequence
  Description of Artificial Sequence: Synthetic oligonucleotide
tttgtatcatcagtggcaagaaaagaca

SEQ ID NO: 460 - DNA, 69 bp, Artificial Sequence
  Description of Artificial Sequence: Synthetic oligonucleotide
aattctaatacgactcactataggtaatttctactaagtgtagattatcatcagtggcaagaaaagaca

SEQ ID NO: 461 - DNA, 28 bp, Artificial Sequence
  Description of Artificial Sequence: Synthetic oligonucleotide
ttttgtatcatcagtggcaagaaaagac

SEQ ID NO: 462 - DNA, 69 bp, Artificial Sequence
  Description of Artificial Sequence: Synthetic oligonucleotide
aattctaatacgactcactataggtaatttctactaagtgtagatgtatcatcagtggcaagaaaagac

SEQ ID NO: 463 - DNA, 28 bp, Artificial Sequence
  Description of Artificial Sequence: Synthetic oligonucleotide
ttttccatccttgtacctggccagggaa

SEQ ID NO: 464 - DNA, 69 bp, Artificial Sequence
  Description of Artificial Sequence: Synthetic oligonucleotide
aattctaatacgactcactataggtaatttctactaagtgtagatccatccttgtacctggccagggaa

SEQ ID NO: 465 - DNA, 21 bp, Homo sapiens
cggacagtgcctttccatcct

SEQ ID NO: 466 - DNA, 21 bp, Artificial Sequence
  Description of Artificial Sequence: Synthetic oligonucleotide
cggacagtgcttttccatcct

SEQ ID NO: 467 - DNA, 28 bp, Artificial Sequence
  Description of Artificial Sequence: Synthetic oligonucleotide
tttcacacgaatgtttgcttacttccga

SEQ ID NO: 468 - DNA, 69 bp, Artificial Sequence
  Description of Artificial Sequence: Synthetic oligonucleotide
aattctaatacgactcactataggtaatttctactaagtgtagatacacgaatgtttgcttacttccga

SEQ ID NO: 469 - DNA, 21 bp, Homo sapiens
ttcgtgtgaaccagttataga

SEQ ID NO: 470 - DNA, 21 bp, Artificial Sequence
  Description of Artificial Sequence: Synthetic oligonucleotide
ttcgtgtgaaacagttataga

SEQ ID NO: 471 - DNA, 28 bp, Artificial Sequence
  Description of Artificial Sequence: Synthetic oligonucleotide
tttcaacgctgacctgaggtttcagagc

SEQ ID NO: 472 - DNA, 69 bp, Artificial Sequence
  Description of Artificial Sequence: Synthetic oligonucleotide
aattctaatacgactcactataggtaatttctactaagtgtagataacgctgacctgaggtttcagagc

SEQ ID NO: 473 - DNA, 21 bp, Homo sapiens
ctcaggtcagtgttgaaatcc

SEQ ID NO: 474 - DNA, 21 bp, Artificial Sequence
  Description of Artificial Sequence: Synthetic oligonucleotide
ctcaggtcagcgttgaaatcc

SEQ ID NO: 475 - DNA, 28 bp, Artificial Sequence
  Description of Artificial Sequence: Synthetic oligonucleotide
tttcggcaataattatcatcaaagccct

SEQ ID NO: 476 - DNA, 69 bp, Artificial Sequence
  Description of Artificial Sequence: Synthetic oligonucleotide
aattctaatacgactcactataggtaatttctactaagtgtagatggcaataattatcatcaaagccct

SEQ ID NO: 477 - DNA, 21 bp, Homo sapiens
catcgggattgcggcaataat

SEQ ID NO: 478 - DNA, 21 bp, Artificial Sequence
  Description of Artificial Sequence: Synthetic oligonucleotide
catcgggatttcggcaataat

SEQ ID NO: 479 - DNA, 28 bp, Artificial Sequence
  Description of Artificial Sequence: Synthetic oligonucleotide
tttgatgataattattgccgaaatcccg

SEQ ID NO: 480 - DNA, 69 bp, Artificial Sequence
  Description of Artificial Sequence: Synthetic oligonucleotide
aattctaatacgactcactataggtaatttctactaagtgtagatatgataattattgccgaaatcccg

SEQ ID NO: 481 - DNA, 28 bp, Artificial Sequence
  Description of Artificial Sequence: Synthetic oligonucleotide
tttgaatacaccaacctctgtgctattc

SEQ ID NO: 482 - DNA, 69 bp, Artificial Sequence
  Description of Artificial Sequence: Synthetic oligonucleotide
aattctaatacgactcactataggtaatttctactaagtgtagataatacaccaacctctgtgctattc

SEQ ID NO: 483 - DNA, 21 bp, Homo sapiens
aggttggtgtcttcaaagaga

SEQ ID NO: 484 - DNA, 21 bp, Artificial Sequence
  Description of Artificial Sequence: Synthetic oligonucleotide
aggttggtgtattcaaagaga

SEQ ID NO: 485 - DNA, 28 bp, Artificial Sequence
  Description of Artificial Sequence: Synthetic oligonucleotide
tttgtagtcccaaggctacgcaggaggt

SEQ ID NO: 486 - DNA, 69 bp, Artificial Sequence
  Description of Artificial Sequence: Synthetic oligonucleotide
aattctaatacgactcactataggtaatttctactaagtgtagattagtcccaaggctacgcaggaggt

SEQ ID NO: 487 - DNA, 21 bp, Homo sapiens
gacctcctgcttagccttggg

SEQ ID NO: 488 - DNA, 21 bp, Artificial Sequence
  Description of Artificial Sequence: Synthetic oligonucleotide
gacctcctgcgtagccttggg

SEQ ID NO: 489 - DNA, 28 bp, Artificial Sequence
  Description of Artificial Sequence: Synthetic oligonucleotide
tttgttcctgaaaatgcgaaatatctga

SEQ ID NO: 490 - DNA, 69 bp, Artificial Sequence
  Description of Artificial Sequence: Synthetic oligonucleotide
aattctaatacgactcactataggtaatttctactaagtgtagatttcctgaaaatgcgaaatatctga

SEQ ID NO: 491 - DNA, 21 bp, Homo sapiens
cctgaaaatgtgaaatatctg

SEQ ID NO: 492 - DNA, 21 bp, Artificial Sequence
  Description of Artificial Sequence: Synthetic oligonucleotide
cctgaaaatgcgaaatatctg

SEQ ID NO: 493 - DNA, 28 bp, Artificial Sequence
  Description of Artificial Sequence: Synthetic oligonucleotide
tttaaatcattttgttcctgaaaatgcg

SEQ ID NO: 494 - DNA, 69 bp, Artificial Sequence
  Description of Artificial Sequence: Synthetic oligonucleotide
aattctaatacgactcactataggtaatttctactaagtgtagataatcattttgttcctgaaaatgcg

SEQ ID NO: 495 - DNA, 28 bp, Artificial Sequence
  Description of Artificial Sequence: Synthetic oligonucleotide
ttttaaatcattttgttcctgaaaatgc

SEQ ID NO: 496 - DNA, 69 bp, Artificial Sequence
  Description of Artificial Sequence: Synthetic oligonucleotide
aattctaatacgactcactataggtaatttctactaagtgtagataaatcattttgttcctgaaaatgc

SEQ ID NO: 497 - DNA, 28 bp, Artificial Sequence
  Description of Artificial Sequence: Synthetic oligonucleotide
ttttgttcctgaaaatgcgaaatatctg

SEQ ID NO: 498 - DNA, 69 bp, Artificial Sequence
  Description of Artificial Sequence: Synthetic oligonucleotide
aattctaatacgactcactataggtaatttctactaagtgtagatgttcctgaaaatgcgaaatatctg

SEQ ID NO: 499 - DNA, 28 bp, Artificial Sequence
  Description of Artificial Sequence: Synthetic oligonucleotide
tttccccttcagatatttcgcattttca

SEQ ID NO: 500 - DNA, 69 bp, Artificial Sequence
  Description of Artificial Sequence: Synthetic oligonucleotide
aattctaatacgactcactataggtaatttctactaagtgtagatcccttcagatatttcgcattttca

SEQ ID NO: 501 - DNA, 28 bp, Artificial Sequence
  Description of Artificial Sequence: Synthetic oligonucleotide
tttcgcattttcaggaacaaaatgattt

SEQ ID NO: 502 - DNA, 69 bp, Artificial Sequence
  Description of Artificial Sequence: Synthetic oligonucleotide
aattctaatacgactcactataggtaatttctactaagtgtagatgcattttcaggaacaaaatgattt

SEQ ID NO: 503 - DNA, 28 bp, Artificial Sequence
  Description of Artificial Sequence: Synthetic oligonucleotide
tttgttttttccccttcagatatttcgc

SEQ ID NO: 504 - DNA, 69 bp, Artificial Sequence
  Description of Artificial Sequence: Synthetic oligonucleotide
aattctaatacgactcactataggtaatttctactaagtgtagatttttttccccttcagatatttcgc

SEQ ID NO: 505 - DNA, 28 bp, Artificial Sequence
  Description of Artificial Sequence: Synthetic oligonucleotide
ttttttccccttcagatatttcgcattt

SEQ ID NO: 506 - DNA, 69 bp, Artificial Sequence
  Description of Artificial Sequence: Synthetic oligonucleotide
aattctaatacgactcactataggtaatttctactaagtgtagatttccccttcagatatttcgcattt

SEQ ID NO: 507 - DNA, 28 bp, Artificial Sequence
  Description of Artificial Sequence: Synthetic oligonucleotide
tttttccccttcagatatttcgcatttt

SEQ ID NO: 508 - DNA, 69 bp, Artificial Sequence
  Description of Artificial Sequence: Synthetic oligonucleotide
aattctaatacgactcactataggtaatttctactaagtgtagattccccttcagatatttcgcatttt

SEQ ID NO: 509 - DNA, 28 bp, Artificial Sequence
  Description of Artificial Sequence: Synthetic oligonucleotide
ttttccccttcagatatttcgcattttc

SEQ ID NO: 510 - DNA, 69 bp, Artificial Sequence
  Description of Artificial Sequence: Synthetic oligonucleotide
aattctaatacgactcactataggtaatttctactaagtgtagatccccttcagatatttcgcattttc

SEQ ID NO: 511 - DNA, 28 bp, Artificial Sequence
  Description of Artificial Sequence: Synthetic oligonucleotide
tttgcttaggtaggaagtttgggcccag

SEQ ID NO: 512 - DNA, 69 bp, Artificial Sequence
  Description of Artificial Sequence: Synthetic oligonucleotide
aattctaatacgactcactataggtaatttctactaagtgtagatcttaggtaggaagtttgggcccag

SEQ ID NO: 513 - DNA, 21 bp, Homo sapiens
cttcctacctgagcaaacaga

SEQ ID NO: 514 - DNA, 21 bp, Artificial Sequence
  Description of Artificial Sequence: Synthetic oligonucleotide
cttcctacctaagcaaacaga

SEQ ID NO: 515 - DNA, 28 bp, Artificial Sequence
  Description of Artificial Sequence: Synthetic oligonucleotide
tttcagataaatgaaaccttctagtctt

SEQ ID NO: 516 - DNA, 69 bp, Artificial Sequence
  Description of Artificial Sequence: Synthetic oligonucleotide
aattctaatacgactcactataggtaatttctactaagtgtagatagataaatgaaaccttctagtctt

SEQ ID NO: 517 - DNA, 21 bp, Homo sapiens
tcagataaatcaaaccttcta

SEQ ID NO: 518 - DNA, 21 bp, Artificial Sequence
  Description of Artificial Sequence: Synthetic oligonucleotide
tcagataaatgaaaccttcta

SEQ ID NO: 519 - DNA, 28 bp, Artificial Sequence
  Description of Artificial Sequence: Synthetic oligonucleotide
tttattttttcagataaatgaaaccttc

SEQ ID NO: 520 - DNA, 69 bp, Artificial Sequence
  Description of Artificial Sequence: Synthetic oligonucleotide
aattctaatacgactcactataggtaatttctactaagtgtagatttttttcagataaatgaaaccttc

SEQ ID NO: 521 - DNA, 28 bp, Artificial Sequence
  Description of Artificial Sequence: Synthetic oligonucleotide
ttttattttttcagataaatgaaacctt

SEQ ID NO: 522 - DNA, 69 bp, Artificial Sequence
  Description of Artificial Sequence: Synthetic oligonucleotide
aattctaatacgactcactataggtaatttctactaagtgtagatattttttcagataaatgaaacctt

SEQ ID NO: 523 - DNA, 28 bp, Artificial Sequence
  Description of Artificial Sequence: Synthetic oligonucleotide
ttttttcagataaatgaaaccttctagt

SEQ ID NO: 524 - DNA, 69 bp, Artificial Sequence
  Description of Artificial Sequence: Synthetic oligonucleotide
aattctaatacgactcactataggtaatttctactaagtgtagatttcagataaatgaaaccttctagt

SEQ ID NO: 525 - DNA, 28 bp, Artificial Sequence
  Description of Artificial Sequence: Synthetic oligonucleotide
tttttcagataaatgaaaccttctagtc

SEQ ID NO: 526 - DNA, 69 bp, Artificial Sequence
  Description of Artificial Sequence: Synthetic oligonucleotide
aattctaatacgactcactataggtaatttctactaagtgtagattcagataaatgaaaccttctagtc

SEQ ID NO: 527 - DNA, 28 bp, Artificial Sequence
  Description of Artificial Sequence: Synthetic oligonucleotide
ttttcagataaatgaaaccttctagtct

SEQ ID NO: 528 - DNA, 69 bp, Artificial Sequence
  Description of Artificial Sequence: Synthetic oligonucleotide
aattctaatacgactcactataggtaatttctactaagtgtagatcagataaatgaaaccttctagtct

SEQ ID NO: 529 - DNA, 28 bp, Artificial Sequence
  Description of Artificial Sequence: Synthetic oligonucleotide
tttcatttatctgaaaaaataaaataca

SEQ ID NO: 530 - DNA, 69 bp, Artificial Sequence
  Description of Artificial Sequence: Synthetic oligonucleotide
aattctaatacgactcactataggtaatttctactaagtgtagatatttatctgaaaaaataaaataca

SEQ ID NO: 531 - DNA, 28 bp, Artificial Sequence
  Description of Artificial Sequence: Synthetic oligonucleotide
tttgacagcttcctcctcactgtatgtg

SEQ ID NO: 532 - DNA, 69 bp, Artificial Sequence
  Description of Artificial Sequence: Synthetic oligonucleotide
aattctaatacgactcactataggtaatttctactaagtgtagatacagcttcctcctcactgtatgtg

SEQ ID NO: 533 - DNA, 21 bp, Homo sapiens
cctggacacagacagtgagga

SEQ ID NO: 534 - DNA, 21 bp, Artificial Sequence
  Description of Artificial Sequence: Synthetic oligonucleotide
cctggacacatacagtgagga

SEQ ID NO: 535 - DNA, 28 bp, Artificial Sequence
  Description of Artificial Sequence: Synthetic oligonucleotide
tttctggtgtagtataatcaggggcact

SEQ ID NO: 536 - DNA, 69 bp, Artificial Sequence
  Description of Artificial Sequence: Synthetic oligonucleotide
aattctaatacgactcactataggtaatttctactaagtgtagattggtgtagtataatcaggggcact

SEQ ID NO: 537 - DNA, 21 bp, Homo sapiens
aatcaggggccctcattctag

SEQ ID NO: 538 - DNA, 21 bp, Artificial Sequence
  Description of Artificial Sequence: Synthetic oligonucleotide
aatcaggggcactcattctag

SEQ ID NO: 539 - DNA, 28 bp, Artificial Sequence
  Description of Artificial Sequence: Synthetic oligonucleotide
tttcgcccggctcgaggtgcaggatgcg

SEQ ID NO: 540 - DNA, 69 bp, Artificial Sequence
  Description of Artificial Sequence: Synthetic oligonucleotide
aattctaatacgactcactataggtaatttctactaagtgtagatgcccggctcgaggtgcaggatgcg

SEQ ID NO: 541 - DNA, 21 bp, Homo sapiens
caccttgctctgcatcctgca

SEQ ID NO: 542 - DNA, 21 bp, Artificial Sequence
  Description of Artificial Sequence: Synthetic oligonucleotide
caccttgctccgcatcctgca

SEQ ID NO: 543 - DNA, 28 bp, Artificial Sequence
  Description of Artificial Sequence: Synthetic oligonucleotide
tttgttataggtaaatgcttggctttct

SEQ ID NO: 544 - DNA, 69 bp, Artificial Sequence
  Description of Artificial Sequence: Synthetic oligonucleotide
aattctaatacgactcactataggtaatttctactaagtgtagatttataggtaaatgcttggctttct

SEQ ID NO: 545 - DNA, 21 bp, Homo sapiens
gtgtttgttagaggtaaatgc

SEQ ID NO: 546 - DNA, 21 bp, Artificial Sequence
  Description of Artificial Sequence: Synthetic oligonucleotide
gtgtttgttataggtaaatgc

SEQ ID NO: 547 - DNA, 28 bp, Artificial Sequence
  Description of Artificial Sequence: Synthetic oligonucleotide
tttatgtgtttgttataggtaaatgctt

SEQ ID NO: 548 - DNA, 69 bp, Artificial Sequence
  Description of Artificial Sequence: Synthetic oligonucleotide
aattctaatacgactcactataggtaatttctactaagtgtagattgtgtttgttataggtaaatgctt

SEQ ID NO: 549 - DNA, 28 bp, Artificial Sequence
  Description of Artificial Sequence: Synthetic oligonucleotide
tttacctataacaaacacataaatggaa

SEQ ID NO: 550 - DNA, 69 bp, Artificial Sequence
  Description of Artificial Sequence: Synthetic oligonucleotide
aattctaatacgactcactataggtaatttctactaagtgtagatcctataacaaacacataaatggaa

SEQ ID NO: 551 - DNA, 28 bp, Artificial Sequence
  Description of Artificial Sequence: Synthetic oligonucleotide
tttcttagaactattgccattggagaga

SEQ ID NO: 552 - DNA, 69 bp, Artificial Sequence
  Description of Artificial Sequence: Synthetic oligonucleotide
aattctaatacgactcactataggtaatttctactaagtgtagatttagaactattgccattggagaga

SEQ ID NO: 553 - DNA, 28 bp, Artificial Sequence
  Description of Artificial Sequence: Synthetic oligonucleotide
tttttcttagaactattgccattggaga

SEQ ID NO: 554 - DNA, 69 bp, Artificial Sequence
  Description of Artificial Sequence: Synthetic oligonucleotide
aattctaatacgactcactataggtaatttctactaagtgtagattcttagaactattgccattggaga

SEQ ID NO: 555 - DNA, 28 bp, Artificial Sequence
  Description of Artificial Sequence: Synthetic oligonucleotide
ttttcttagaactattgccattggagag

SEQ ID NO: 556 - DNA, 69 bp, Artificial Sequence
  Description of Artificial Sequence: Synthetic oligonucleotide
aattctaatacgactcactataggtaatttctactaagtgtagatcttagaactattgccattggagag

SEQ ID NO: 557 - DNA, 28 bp, Artificial Sequence
  Description of Artificial Sequence: Synthetic oligonucleotide
tttgctacattttccacttcttcctcag

SEQ ID NO: 558 - DNA, 69 bp, Artificial Sequence
  Description of Artificial Sequence: Synthetic oligonucleotide
aattctaatacgactcactataggtaatttctactaagtgtagatctacattttccacttcttcctcag

SEQ ID NO: 559 - DNA, 21 bp, Homo sapiens
aaaccaatgtctgctacattt

SEQ ID NO: 560 - DNA, 21 bp, Artificial Sequence
  Description of Artificial Sequence: Synthetic oligonucleotide
aaaccaatgtttgctacattt

SEQ ID NO: 561 - DNA, 28 bp, Artificial Sequence
  Description of Artificial Sequence: Synthetic oligonucleotide
tttgctgagcagcataccccggtgtgta

SEQ ID NO: 562 - DNA, 69 bp, Artificial Sequence
  Description of Artificial Sequence: Synthetic oligonucleotide
aattctaatacgactcactataggtaatttctactaagtgtagatctgagcagcataccccggtgtgta

SEQ ID NO: 563 - DNA, 21 bp, Homo sapiens
tgctcagcaacggagcggata

SEQ ID NO: 564 - DNA, 21 bp, Artificial Sequence
  Description of Artificial Sequence: Synthetic oligonucleotide
tgctcagcaaaggagcggata

SEQ ID NO: 565 - DNA, 28 bp, Artificial Sequence
  Description of Artificial Sequence: Synthetic oligonucleotide
tttattgaaacatcagccaagacaagac

SEQ ID NO: 566 - DNA, 69 bp, Artificial Sequence
  Description of Artificial Sequence: Synthetic oligonucleotide
aattctaatacgactcactataggtaatttctactaagtgtagatttgaaacatcagccaagacaagac

SEQ ID NO: 567 - DNA, 21 bp, Homo sapiens
gtcttgtctttgctgatgttt

SEQ ID NO: 568 - DNA, 21 bp, Artificial Sequence
  Description of Artificial Sequence: Synthetic oligonucleotide
gtcttgtcttggctgatgttt

SEQ ID NO: 569 - DNA, 28 bp, Artificial Sequence
  Description of Artificial Sequence: Synthetic oligonucleotide
ttttattgaaacatcagccaagacaaga

SEQ ID NO: 570 - DNA, 69 bp, Artificial Sequence
  Description of Artificial Sequence: Synthetic oligonucleotide
aattctaatacgactcactataggtaatttctactaagtgtagatattgaaacatcagccaagacaaga

SEQ ID NO: 571 - DNA, 28 bp, Artificial Sequence
  Description of Artificial Sequence: Synthetic oligonucleotide
tttaaaaaatggatgagcatttatttca

SEQ ID NO: 572 - DNA, 69 bp, Artificial Sequence
  Description of Artificial Sequence: Synthetic oligonucleotide
aattctaatacgactcactataggtaatttctactaagtgtagataaaaatggatgagcatttatttca

SEQ ID NO: 573 - DNA, 21 bp, Homo sapiens
atggatgagcttttatttcat

SEQ ID NO: 574 - DNA, 21 bp, Artificial Sequence
  Description of Artificial Sequence: Synthetic oligonucleotide
atggatgagcatttatttcat

SEQ ID NO: 575 - DNA, 28 bp, Artificial Sequence
  Description of Artificial Sequence: Synthetic oligonucleotide
ttttaaaaaatggatgagcatttatttc

SEQ ID NO: 576 - DNA, 69 bp, Artificial Sequence
  Description of Artificial Sequence: Synthetic oligonucleotide
aattctaatacgactcactataggtaatttctactaagtgtagataaaaaatggatgagcatttatttc

SEQ ID NO: 577 - DNA, 28 bp, Artificial Sequence
  Description of Artificial Sequence: Synthetic oligonucleotide
tttaaaaaatggatgagcttatatttca

SEQ ID NO: 578 - DNA, 69 bp, Artificial Sequence
  Description of Artificial Sequence: Synthetic oligonucleotide
aattctaatacgactcactataggtaatttctactaagtgtagataaaaatggatgagcttatatttca

SEQ ID NO: 579 - DNA, 21 bp, Homo sapiens
ggatgagcttttatttcatca

SEQ ID NO: 580 - DNA, 21 bp, Artificial Sequence
  Description of Artificial Sequence: Synthetic oligonucleotide
ggatgagcttatatttcatca

SEQ ID NO: 581 - DNA, 28 bp, Artificial Sequence
  Description of Artificial Sequence: Synthetic oligonucleotide
ttttaaaaaatggatgagcttatatttc

SEQ ID NO: 582 - DNA, 69 bp, Artificial Sequence
  Description of Artificial Sequence: Synthetic oligonucleotide
aattctaatacgactcactataggtaatttctactaagtgtagataaaaaatggatgagcttatatttc

SEQ ID NO: 583 - DNA, 28 bp, Artificial Sequence
  Description of Artificial Sequence: Synthetic oligonucleotide
tttggttctgcgggtagcccctgaaccg

SEQ ID NO: 584 - DNA, 69 bp, Artificial Sequence
  Description of Artificial Sequence: Synthetic oligonucleotide
aattctaatacgactcactataggtaatttctactaagtgtagatgttctgcgggtagcccctgaaccg

SEQ ID NO: 585 - DNA, 21 bp, Homo sapiens
actgtttggtcctgcgggtag

SEQ ID NO: 586 - DNA, 21 bp, Artificial Sequence
  Description of Artificial Sequence: Synthetic oligonucleotide
actgtttggttctgcgggtag

SEQ ID NO: 587 - DNA, 28 bp, Artificial Sequence
  Description of Artificial Sequence: Synthetic oligonucleotide
tttcttaccccgaagcagaaggtgggag

SEQ ID NO: 588 - DNA, 69 bp, Artificial Sequence
  Description of Artificial Sequence: Synthetic oligonucleotide
aattctaatacgactcactataggtaatttctactaagtgtagatttaccccgaagcagaaggtgggag

SEQ ID NO: 589 - DNA, 21 bp, Homo sapiens
tttcttacccagaagcagaag

SEQ ID NO: 590 - DNA, 21 bp, Artificial Sequence
  Description of Artificial Sequence: Synthetic oligonucleotide
tttcttaccccgaagcagaag

SEQ ID NO: 591 - DNA, 28 bp, Artificial Sequence
  Description of Artificial Sequence: Synthetic oligonucleotide
tttagaaatcagtccccataatgtggat

SEQ ID NO: 592 - DNA, 69 bp, Artificial Sequence
  Description of Artificial Sequence: Synthetic oligonucleotide
aattctaatacgactcactataggtaatttctactaagtgtagatgaaatcagtccccataatgtggat

SEQ ID NO: 593 - DNA, 21 bp, Homo sapiens
tcagtccccagaatgtggatg

SEQ ID NO: 594 - DNA, 21 bp, Artificial Sequence
  Description of Artificial Sequence: Synthetic oligonucleotide
tcagtccccataatgtggatg

SEQ ID NO: 595 - DNA, 28 bp, Artificial Sequence
  Description of Artificial Sequence: Synthetic oligonucleotide
tttgtaagacagttttattttactgttt

SEQ ID NO: 596 - DNA, 69 bp, Artificial Sequence
  Description of Artificial Sequence: Synthetic oligonucleotide
aattctaatacgactcactataggtaatttctactaagtgtagattaagacagttttattttactgttt

SEQ ID NO: 597 - DNA, 22 bp, Homo sapiens
actgtcttacctaaaccatata

SEQ ID NO: 598 - DNA, 22 bp, Artificial Sequence
  Description of Artificial Sequence: Synthetic oligonucleotide
actgtcttacaaaaaccatata

SEQ ID NO: 599 - DNA, 28 bp, Artificial Sequence
  Description of Artificial Sequence: Synthetic oligonucleotide
tttttgtaagacagttttattttactgt

SEQ ID NO: 600 - DNA, 69 bp, Artificial Sequence
  Description of Artificial Sequence: Synthetic oligonucleotide
aattctaatacgactcactataggtaatttctactaagtgtagattgtaagacagttttattttactgt

SEQ ID NO: 601 - DNA, 28 bp, Artificial Sequence
  Description of Artificial Sequence: Synthetic oligonucleotide
ttttgtaagacagttttattttactgtt

SEQ ID NO: 602 - DNA, 69 bp, Artificial Sequence
  Description of Artificial Sequence: Synthetic oligonucleotide
aattctaatacgactcactataggtaatttctactaagtgtagatgtaagacagttttattttactgtt

SEQ ID NO: 603 - DNA, 28 bp, Artificial Sequence
  Description of Artificial Sequence: Synthetic oligonucleotide
tttggcctggtgatctcacagcccaccc

SEQ ID NO: 604 - DNA, 69 bp, Artificial Sequence
  Description of Artificial Sequence: Synthetic oligonucleotide
aattctaatacgactcactataggtaatttctactaagtgtagatgcctggtgatctcacagcccaccc

SEQ ID NO: 605 - DNA, 21 bp, Homo sapiens
tgagatcacctggccaaaggc

SEQ ID NO: 606 - DNA, 21 bp, Artificial Sequence
  Description of Artificial Sequence: Synthetic oligonucleotide
tgagatcaccaggccaaaggc

SEQ ID NO: 607 - DNA, 28 bp, Artificial Sequence
  Description of Artificial Sequence: Synthetic oligonucleotide
tttctttcctgctgtcctgacagatcaa

SEQ ID NO: 608 - DNA, 69 bp, Artificial Sequence
  Description of Artificial Sequence: Synthetic oligonucleotide
aattctaatacgactcactataggtaatttctactaagtgtagattttcctgctgtcctgacagatcaa

SEQ ID NO: 609 - DNA, 21 bp, Homo sapiens
tctttcctgccgtcctgacag

SEQ ID NO: 610 - DNA, 21 bp, Artificial Sequence
  Description of Artificial Sequence: Synthetic oligonucleotide
tctttcctgctgtcctgacag

SEQ ID NO: 611 - DNA, 28 bp, Artificial Sequence
  Description of Artificial Sequence: Synthetic oligonucleotide
tttcctgctgtcctgacagatcaacatt

SEQ ID NO: 612 - DNA, 69 bp, Artificial Sequence
  Description of Artificial Sequence: Synthetic oligonucleotide
aattctaatacgactcactataggtaatttctactaagtgtagatctgctgtcctgacagatcaacatt

SEQ ID NO: 613 - DNA, 28 bp, Artificial Sequence
  Description of Artificial Sequence: Synthetic oligonucleotide
tttgaagatttgttttctttcctgctgt

SEQ ID NO: 614 - DNA, 69 bp, Artificial Sequence
  Description of Artificial Sequence: Synthetic oligonucleotide
aattctaatacgactcactataggtaatttctactaagtgtagataagatttgttttctttcctgctgt

SEQ ID NO: 615 - DNA, 28 bp, Artificial Sequence
  Description of Artificial Sequence: Synthetic oligonucleotide
tttgttttctttcctgctgtcctgacag

SEQ ID NO: 616 - DNA, 69 bp, Artificial Sequence
  Description of Artificial Sequence: Synthetic oligonucleotide
aattctaatacgactcactataggtaatttctactaagtgtagatttttctttcctgctgtcctgacag

SEQ ID NO: 617 - DNA, 28 bp, Artificial Sequence
  Description of Artificial Sequence: Synthetic oligonucleotide
ttttctttcctgctgtcctgacagatca

SEQ ID NO: 618 - DNA, 69 bp, Artificial Sequence
  Description of Artificial Sequence: Synthetic oligonucleotide
aattctaatacgactcactataggtaatttctactaagtgtagatctttcctgctgtcctgacagatca

SEQ ID NO: 619 - DNA, 28 bp, Artificial Sequence
  Description of Artificial Sequence: Synthetic oligonucleotide
tttcgctttgaagatttgttttctttcc

SEQ ID NO: 620 - DNA, 69 bp, Artificial Sequence
  Description of Artificial Sequence: Synthetic oligonucleotide
aattctaatacgactcactataggtaatttctactaagtgtagatgctttgaagatttgttttctttcc

SEQ ID NO: 621 - DNA, 21 bp, Homo sapiens
aaatgttttccctttgaagat

SEQ ID NO: 622 - DNA, 21 bp, Artificial Sequence
  Description of Artificial Sequence: Synthetic oligonucleotide
aaatgttttcgctttgaagat

SEQ ID NO: 623 - DNA, 28 bp, Artificial Sequence
  Description of Artificial Sequence: Synthetic oligonucleotide
ttttcgctttgaagatttgttttctttc

SEQ ID NO: 624 - DNA, 69 bp, Artificial Sequence
  Description of Artificial Sequence: Synthetic oligonucleotide
aattctaatacgactcactataggtaatttctactaagtgtagatcgctttgaagatttgttttctttc

SEQ ID NO: 625 - DNA, 28 bp, Artificial Sequence
  Description of Artificial Sequence: Synthetic oligonucleotide
tttccgtggtgggctcaagctcaacagc

SEQ ID NO: 626 - DNA, 69 bp, Artificial Sequence
  Description of Artificial Sequence: Synthetic oligonucleotide
aattctaatacgactcactataggtaatttctactaagtgtagatcgtggtgggctcaagctcaacagc

SEQ ID NO: 627 - DNA, 21 bp, Homo sapiens
caagctcaaccgcaggttctg

SEQ ID NO: 628 - DNA, 21 bp, Artificial Sequence
  Description of Artificial Sequence: Synthetic oligonucleotide
caagctcaacagcaggttctg

SEQ ID NO: 629 - DNA, 28 bp, Artificial Sequence
  Description of Artificial Sequence: Synthetic oligonucleotide
tttcgaggaaatacccccttacaccttg

SEQ ID NO: 630 - DNA, 69 bp, Artificial Sequence
  Description of Artificial Sequence: Synthetic oligonucleotide
aattctaatacgactcactataggtaatttctactaagtgtagatgaggaaatacccccttacaccttg

SEQ ID NO: 631 - DNA, 21 bp, Homo sapiens
gcaaggtgtaggggggtattt

SEQ ID NO: 632 - DNA, 21 bp, Artificial Sequence
  Description of Artificial Sequence: Synthetic oligonucleotide
gcaaggtgtaagggggtattt

SEQ ID NO: 633 - DNA, 28 bp, Artificial Sequence
  Description of Artificial Sequence: Synthetic oligonucleotide
tttgacggtcagaattgtgaagtgaacg

SEQ ID NO: 634 - DNA, 69 bp, Artificial Sequence
  Description of Artificial Sequence: Synthetic oligonucleotide
aattctaatacgactcactataggtaatttctactaagtgtagatacggtcagaattgtgaagtgaacg

SEQ ID NO: 635 - DNA, 21 bp, Homo sapiens
aattctgaccctcaaacccta

SEQ ID NO: 636 - DNA, 21 bp, Artificial Sequence
  Description of Artificial Sequence: Synthetic oligonucleotide
aattctgaccgtcaaacccta

SEQ ID NO: 637 - DNA, 28 bp, Artificial Sequence
  Description of Artificial Sequence: Synthetic oligonucleotide
tttccagctgtatccagtatgtccaaca

SEQ ID NO: 638 - DNA, 69 bp, Artificial Sequence
  Description of Artificial Sequence: Synthetic oligonucleotide
aattctaatacgactcactataggtaatttctactaagtgtagatcagctgtatccagtatgtccaaca

SEQ ID NO: 639 - DNA, 21 bp, Homo sapiens
tactcttcttgtccagctgta

SEQ ID NO: 640 - DNA, 21 bp, Artificial Sequence
  Description of Artificial Sequence: Synthetic oligonucleotide
tactcttcttttccagctgta

SEQ ID NO: 641 - DNA, 28 bp, Artificial Sequence
  Description of Artificial Sequence: Synthetic oligonucleotide
ttttccagctgtatccagtatgtccaac

SEQ ID NO: 642 - DNA, 69 bp, Artificial Sequence
  Description of Artificial Sequence: Synthetic oligonucleotide
aattctaatacgactcactataggtaatttctactaagtgtagatccagctgtatccagtatgtccaac

SEQ ID NO: 643 - DNA, 28 bp, Artificial Sequence
  Description of Artificial Sequence: Synthetic oligonucleotide
tttgcttttcctcatcacctgctccaat

SEQ ID NO: 644 - DNA, 69 bp, Artificial Sequence
  Description of Artificial Sequence: Synthetic oligonucleotide
aattctaatacgactcactataggtaatttctactaagtgtagatcttttcctcatcacctgctccaat

SEQ ID NO: 645 - DNA, 21 bp, Homo sapiens
gaggaaaagcgaagtgattcc

SEQ ID NO: 646 - DNA, 21 bp, Artificial Sequence
  Description of Artificial Sequence: Synthetic oligonucleotide
gaggaaaagcaaagtgattcc

SEQ ID NO: 647 - DNA, 28 bp, Artificial Sequence
  Description of Artificial Sequence: Synthetic oligonucleotide
tttggggttgccttgcacagtgaatgga

SEQ ID NO: 648 - DNA, 69 bp, Artificial Sequence
  Description of Artificial Sequence: Synthetic oligonucleotide
aattctaatacgactcactataggtaatttctactaagtgtagatgggttgccttgcacagtgaatgga

SEQ ID NO: 649 - DNA, 21 bp, Homo sapiens
attcactgtgaaaggcaaccc

SEQ ID NO: 650 - DNA, 21 bp, Artificial Sequence
  Description of Artificial Sequence: Synthetic oligonucleotide
attcactgtgcaaggcaaccc

SEQ ID NO: 651 - DNA, 28 bp, Artificial Sequence
  Description of Artificial Sequence: Synthetic oligonucleotide
tttccttgtgcctccaaacttacaggtg

SEQ ID NO: 652 - DNA, 69 bp, Artificial Sequence
  Description of Artificial Sequence: Synthetic oligonucleotide
aattctaatacgactcactataggtaatttctactaagtgtagatcttgtgcctccaaacttacaggtg

SEQ ID NO: 653 - DNA, 21 bp, Homo sapiens
tcatttttttgccttgtgcct

SEQ ID NO: 654 - DNA, 21 bp, Artificial Sequence
  Description of Artificial Sequence: Synthetic oligonucleotide
tcattttttttccttgtgcct

SEQ ID NO: 655 - DNA, 28 bp, Artificial Sequence
  Description of Artificial Sequence: Synthetic oligonucleotide
ttttttttccttgtgcctccaaacttac

SEQ ID NO: 656 - DNA, 69 bp, Artificial Sequence
  Description of Artificial Sequence: Synthetic oligonucleotide
aattctaatacgactcactataggtaatttctactaagtgtagatttttccttgtgcctccaaacttac

SEQ ID NO: 657 - DNA, 28 bp, Artificial Sequence
  Description of Artificial Sequence: Synthetic oligonucleotide
tttttttccttgtgcctccaaacttaca

SEQ ID NO: 658 - DNA, 69 bp, Artificial Sequence
  Description of Artificial Sequence: Synthetic oligonucleotide
aattctaatacgactcactataggtaatttctactaagtgtagattttccttgtgcctccaaacttaca

SEQ ID NO: 659 - DNA, 28 bp, Artificial Sequence
  Description of Artificial Sequence: Synthetic oligonucleotide
ttttttccttgtgcctccaaacttacag

SEQ ID NO: 660 - DNA, 69 bp, Artificial Sequence
  Description of Artificial Sequence: Synthetic oligonucleotide
aattctaatacgactcactataggtaatttctactaagtgtagatttccttgtgcctccaaacttacag

SEQ ID NO: 661 - DNA, 28 bp, Artificial Sequence
  Description of Artificial Sequence: Synthetic oligonucleotide
tttttccttgtgcctccaaacttacagg

SEQ ID NO: 662 - DNA, 69 bp, Artificial Sequence
  Description of Artificial Sequence: Synthetic oligonucleotide
aattctaatacgactcactataggtaatttctactaagtgtagattccttgtgcctccaaacttacagg

SEQ ID NO: 663 - DNA, 28 bp, Artificial Sequence
  Description of Artificial Sequence: Synthetic oligonucleotide
ttttccttgtgcctccaaacttacaggt

SEQ ID NO: 664 - DNA, 69 bp, Artificial Sequence
  Description of Artificial Sequence: Synthetic oligonucleotide
aattctaatacgactcactataggtaatttctactaagtgtagatccttgtgcctccaaacttacaggt

SEQ ID NO: 665 - DNA, 28 bp, Artificial Sequence
  Description of Artificial Sequence: Synthetic oligonucleotide
tttggaggcacaaggaaaaaaaatgact

SEQ ID NO: 666 - DNA, 69 bp, Artificial Sequence
  Description of Artificial Sequence: Synthetic oligonucleotide
aattctaatacgactcactataggtaatttctactaagtgtagatgaggcacaaggaaaaaaaatgact

SEQ ID NO: 667 - DNA, 28 bp, Artificial Sequence
  Description of Artificial Sequence: Synthetic oligonucleotide
tttcttaaacctacctcattcgaatact

SEQ ID NO: 668 - DNA, 69 bp, Artificial Sequence
  Description of Artificial Sequence: Synthetic oligonucleotide
aattctaatacgactcactataggtaatttctactaagtgtagatttaaacctacctcattcgaatact

SEQ ID NO: 669 - DNA, 21 bp, Homo sapiens
ctcattcgaagacttgactta

SEQ ID NO: 670 - DNA, 21 bp, Artificial Sequence
  Description of Artificial Sequence: Synthetic oligonucleotide
ctcattcgaatacttgactta

SEQ ID NO: 671 - DNA, 28 bp, Artificial Sequence
  Description of Artificial Sequence: Synthetic oligonucleotide
ttttcttaaacctacctcattcgaatac

SEQ ID NO: 672 - DNA, 69 bp, Artificial Sequence
  Description of Artificial Sequence: Synthetic oligonucleotide
aattctaatacgactcactataggtaatttctactaagtgtagatcttaaacctacctcattcgaatac

SEQ ID NO: 673 - DNA, 28 bp, Artificial Sequence
  Description of Artificial Sequence: Synthetic oligonucleotide
tttgtattcttctcatcatcacctttat

SEQ ID NO: 674 - DNA, 69 bp, Artificial Sequence
  Description of Artificial Sequence: Synthetic oligonucleotide
aattctaatacgactcactataggtaatttctactaagtgtagattattcttctcatcatcacctttat

SEQ ID NO: 675 - DNA, 21 bp, Homo sapiens
tctgagttgtctgtattcttc

SEQ ID NO: 676 - DNA, 21 bp, Artificial Sequence
  Description of Artificial Sequence: Synthetic oligonucleotide
tctgagttgtttgtattcttc

SEQ ID NO: 677 - DNA, 28 bp, Artificial Sequence
  Description of Artificial Sequence: Synthetic oligonucleotide
tttatccctccaaacgtttgtgcatgac

SEQ ID NO: 678 - DNA, 69 bp, Artificial Sequence
  Description of Artificial Sequence: Synthetic oligonucleotide
aattctaatacgactcactataggtaatttctactaagtgtagattccctccaaacgtttgtgcatgac

SEQ ID NO: 679 - DNA, 21 bp, Homo sapiens
atgcacaaacatttggaggga

SEQ ID NO: 680 - DNA, 21 bp, Artificial Sequence
  Description of Artificial Sequence: Synthetic oligonucleotide
atgcacaaacgtttggaggga

SEQ ID NO: 681 - DNA, 28 bp, Artificial Sequence
  Description of Artificial Sequence: Synthetic oligonucleotide
tttttatccctccaaacgtttgtgcatg

SEQ ID NO: 682 - DNA, 69 bp, Artificial Sequence
  Description of Artificial Sequence: Synthetic oligonucleotide
aattctaatacgactcactataggtaatttctactaagtgtagattatccctccaaacgtttgtgcatg

SEQ ID NO: 683 - DNA, 28 bp, Artificial Sequence
  Description of Artificial Sequence: Synthetic oligonucleotide
ttttatccctccaaacgtttgtgcatga

SEQ ID NO: 684 - DNA, 69 bp, Artificial Sequence
  Description of Artificial Sequence: Synthetic oligonucleotide
aattctaatacgactcactataggtaatttctactaagtgtagatatccctccaaacgtttgtgcatga

SEQ ID NO: 685 - DNA, 28 bp, Artificial Sequence
  Description of Artificial Sequence: Synthetic oligonucleotide
tttaagggttacattcaacaatgcttgg

SEQ ID NO: 686 - DNA, 69 bp, Artificial Sequence
  Description of Artificial Sequence: Synthetic oligonucleotide
aattctaatacgactcactataggtaatttctactaagtgtagatagggttacattcaacaatgcttgg

SEQ ID NO: 687 - DNA, 21 bp, Homo sapiens
cattgttgaaggtaaccctta

SEQ ID NO: 688 - DNA, 21 bp, Artificial Sequence
  Description of Artificial Sequence: Synthetic oligonucleotide
cattgttgaatgtaaccctta

SEQ ID NO: 689 - DNA, 28 bp, Artificial Sequence
  Description of Artificial Sequence: Synthetic oligonucleotide
tttatgtaattttattaaagattttgct

SEQ ID NO: 690 - DNA, 69 bp, Artificial Sequence
  Description of Artificial Sequence: Synthetic oligonucleotide
aattctaatacgactcactataggtaatttctactaagtgtagattgtaattttattaaagattttgct

SEQ ID NO: 691 - DNA, 21 bp, Homo sapiens
tttattaaaggttttgctatc

SEQ ID NO: 692 - DNA, 21 bp, Artificial Sequence
  Description of Artificial Sequence: Synthetic oligonucleotide
tttattaaagattttgctatc

SEQ ID NO: 693 - DNA, 28 bp, Artificial Sequence
  Description of Artificial Sequence: Synthetic oligonucleotide
tttattaaagattttgctatcggcatgc

SEQ ID NO: 694 - DNA, 69 bp, Artificial Sequence
  Description of Artificial Sequence: Synthetic oligonucleotide
aattctaatacgactcactataggtaatttctactaagtgtagatttaaagattttgctatcggcatgc

SEQ ID NO: 695 - DNA, 28 bp, Artificial Sequence
  Description of Artificial Sequence: Synthetic oligonucleotide
ttttattaaagattttgctatcggcatg

SEQ ID NO: 696 - DNA, 69 bp, Artificial Sequence
  Description of Artificial Sequence: Synthetic oligonucleotide
aattctaatacgactcactataggtaatttctactaagtgtagatattaaagattttgctatcggcatg

SEQ ID NO: 697 - DNA, 28 bp, Artificial Sequence
  Description of Artificial Sequence: Synthetic oligonucleotide
tttctcctgcttagtgatttcagagaga

SEQ ID NO: 698 - DNA, 69 bp, Artificial Sequence
  Description of Artificial Sequence: Synthetic oligonucleotide
aattctaatacgactcactataggtaatttctactaagtgtagattcctgcttagtgatttcagagaga

SEQ ID NO: 699 - DNA, 21 bp, Homo sapiens
tgaaatcactgagcaggagaa

SEQ ID NO: 700 - DNA, 21 bp, Artificial Sequence
  Description of Artificial Sequence: Synthetic oligonucleotide
tgaaatcactaagcaggagaa

SEQ ID NO: 701 - DNA, 28 bp, Artificial Sequence
  Description of Artificial Sequence: Synthetic oligonucleotide
tttctacacgagatcctctctctaaaat

SEQ ID NO: 702 - DNA, 69 bp, Artificial Sequence
  Description of Artificial Sequence: Synthetic oligonucleotide
aattctaatacgactcactataggtaatttctactaagtgtagattacacgagatcctctctctaaaat

SEQ ID NO: 703 - DNA, 21 bp, Homo sapiens
tcctctctctgaaatcactga

SEQ ID NO: 704 - DNA, 21 bp, Artificial Sequence
  Description of Artificial Sequence: Synthetic oligonucleotide
tcctctctctaaaatcactga

SEQ ID NO: 705 - DNA, 28 bp, Artificial Sequence
  Description of Artificial Sequence: Synthetic oligonucleotide
tttctcctgctcagtgattttagagaga

SEQ ID NO: 706 - DNA, 69 bp, Artificial Sequence
  Description of Artificial Sequence: Synthetic oligonucleotide
aattctaatacgactcactataggtaatttctactaagtgtagattcctgctcagtgattttagagaga

SEQ ID NO: 707 - DNA, 28 bp, Artificial Sequence
  Description of Artificial Sequence: Synthetic oligonucleotide
tttagagagaggatctcgtgtagaaatt

SEQ ID NO: 708 - DNA, 69 bp, Artificial Sequence
  Description of Artificial Sequence: Synthetic oligonucleotide
aattctaatacgactcactataggtaatttctactaagtgtagatgagagaggatctcgtgtagaaatt

SEQ ID NO: 709 - DNA, 28 bp, Artificial Sequence
  Description of Artificial Sequence: Synthetic oligonucleotide
ttttagagagaggatctcgtgtagaaat

SEQ ID NO: 710 - DNA, 69 bp, Artificial Sequence
  Description of Artificial Sequence: Synthetic oligonucleotide
aattctaatacgactcactataggtaatttctactaagtgtagatagagagaggatctcgtgtagaaat

SEQ ID NO: 711 - DNA, 28 bp, Artificial Sequence
  Description of Artificial Sequence: Synthetic oligonucleotide
tttccgtgaacttacgtagaatatattg

SEQ ID NO: 712 - DNA, 69 bp, Artificial Sequence
  Description of Artificial Sequence: Synthetic oligonucleotide
aattctaatacgactcactataggtaatttctactaagtgtagatcgtgaacttacgtagaatatattg

SEQ ID NO: 713 - DNA, 21 bp, Homo sapiens
ggactttccgggaacttacgt

SEQ ID NO: 714 - DNA, 21 bp, Artificial Sequence
  Description of Artificial Sequence: Synthetic oligonucleotide
ggactttccgtgaacttacgt

SEQ ID NO: 715 - DNA, 28 bp, Artificial Sequence
  Description of Artificial Sequence: Synthetic oligonucleotide
tttgaaagcgtcagccaaaacgtgaaca

SEQ ID NO: 716 - DNA, 69 bp, Artificial Sequence
  Description of Artificial Sequence: Synthetic oligonucleotide
aattctaatacgactcactataggtaatttctactaagtgtagataaagcgtcagccaaaacgtgaaca

SEQ ID NO: 717 - DNA, 21 bp, Homo sapiens
tgatcgatgtgcacgttttgg

SEQ ID NO: 718 - DNA, 21 bp, Artificial Sequence
  Description of Artificial Sequence: Synthetic oligonucleotide
tgatcgatgttcacgttttgg

SEQ ID NO: 719 - DNA, 28 bp, Artificial Sequence
  Description of Artificial Sequence: Synthetic oligonucleotide
tttctcatcataatgggccaggttttca

SEQ ID NO: 720 - DNA, 69 bp, Artificial Sequence
  Description of Artificial Sequence: Synthetic oligonucleotide
aattctaatacgactcactataggtaatttctactaagtgtagattcatcataatgggccaggttttca

SEQ ID NO: 721 - DNA, 21 bp, Homo sapiens
tcataatggggcaggttttca

SEQ ID NO: 722 - DNA, 21 bp, Artificial Sequence
  Description of Artificial Sequence: Synthetic oligonucleotide
tcataatgggccaggttttca

SEQ ID NO: 723 - DNA, 28 bp, Artificial Sequence
  Description of Artificial Sequence: Synthetic oligonucleotide
ttttctcatcataatgggccaggttttc

SEQ ID NO: 724 - DNA, 69 bp, Artificial Sequence
  Description of Artificial Sequence: Synthetic oligonucleotide
aattctaatacgactcactataggtaatttctactaagtgtagatctcatcataatgggccaggttttc

SEQ ID NO: 725 - DNA, 28 bp, Artificial Sequence
  Description of Artificial Sequence: Synthetic oligonucleotide
tttatcaatgaggaagatgaaaacctgg

SEQ ID NO: 726 - DNA, 69 bp, Artificial Sequence
  Description of Artificial Sequence: Synthetic oligonucleotide
aattctaatacgactcactataggtaatttctactaagtgtagattcaatgaggaagatgaaaacctgg

SEQ ID NO: 727 - DNA, 28 bp, Artificial Sequence
  Description of Artificial Sequence: Synthetic oligonucleotide
tttgcaaagctaccctgaaaggaaacaa

SEQ ID NO: 728 - DNA, 69 bp, Artificial Sequence
  Description of Artificial Sequence: Synthetic oligonucleotide
aattctaatacgactcactataggtaatttctactaagtgtagatcaaagctaccctgaaaggaaacaa

SEQ ID NO: 729 - DNA, 21 bp, Homo sapiens
tttgcaaagccaccctgaaag

SEQ ID NO: 730 - DNA, 21 bp, Artificial Sequence
  Description of Artificial Sequence: Synthetic oligonucleotide
tttgcaaagctaccctgaaag

SEQ ID NO: 731 - DNA, 28 bp, Artificial Sequence
  Description of Artificial Sequence: Synthetic oligonucleotide
ttttgcaaagctaccctgaaaggaaaca

SEQ ID NO: 732 - DNA, 69 bp, Artificial Sequence
  Description of Artificial Sequence: Synthetic oligonucleotide
aattctaatacgactcactataggtaatttctactaagtgtagatgcaaagctaccctgaaaggaaaca

SEQ ID NO: 733 - DNA, 28 bp, Artificial Sequence
  Description of Artificial Sequence: Synthetic oligonucleotide
tttcctttcagggtagctttgcaaaatg

SEQ ID NO: 734 - DNA, 69 bp, Artificial Sequence
  Description of Artificial Sequence: Synthetic oligonucleotide
aattctaatacgactcactataggtaatttctactaagtgtagatctttcagggtagctttgcaaaatg

SEQ ID NO: 735 - DNA, 28 bp, Artificial Sequence
  Description of Artificial Sequence: Synthetic oligonucleotide
tttcagggtagctttgcaaaatgttacg

SEQ ID NO: 736 - DNA, 69 bp, Artificial Sequence
  Description of Artificial Sequence: Synthetic oligonucleotide
aattctaatacgactcactataggtaatttctactaagtgtagatagggtagctttgcaaaatgttacg

SEQ ID NO: 737 - DNA, 28 bp, Artificial Sequence
  Description of Artificial Sequence: Synthetic oligonucleotide
tttgtttcctttcagggtagctttgcaa

SEQ ID NO: 738 - DNA, 69 bp, Artificial Sequence
  Description of Artificial Sequence: Synthetic oligonucleotide
aattctaatacgactcactataggtaatttctactaagtgtagattttcctttcagggtagctttgcaa

SEQ ID NO: 739 - DNA, 28 bp, Artificial Sequence
  Description of Artificial Sequence: Synthetic oligonucleotide
tttggcgaaggccaagaggccgcccacc

SEQ ID NO: 740 - DNA, 69 bp, Artificial Sequence
  Description of Artificial Sequence: Synthetic oligonucleotide
aattctaatacgactcactataggtaatttctactaagtgtagatgcgaaggccaagaggccgcccacc

SEQ ID NO: 741 - DNA, 21 bp, Homo sapiens
gggcggcctcctggccttcgc

SEQ ID NO: 742 - DNA, 21 bp, Artificial Sequence
  Description of Artificial Sequence: Synthetic oligonucleotide
gggcggcctcttggccttcgc

SEQ ID NO: 743 - DNA, 28 bp, Artificial Sequence
  Description of Artificial Sequence: Synthetic oligonucleotide
tttcaacagttggagattgaccattatg

SEQ ID NO: 744 - DNA, 69 bp, Artificial Sequence
  Description of Artificial Sequence: Synthetic oligonucleotide
aattctaatacgactcactataggtaatttctactaagtgtagataacagttggagattgaccattatg

SEQ ID NO: 745 - DNA, 21 bp, Homo sapiens
ccctcatcttccaacagttgg

SEQ ID NO: 746 - DNA, 21 bp, Artificial Sequence
  Description of Artificial Sequence: Synthetic oligonucleotide
ccctcatctttcaacagttgg

SEQ ID NO: 747 - DNA, 28 bp, Artificial Sequence
  Description of Artificial Sequence: Synthetic oligonucleotide
tttcactcagggatgatgcgccacttcc

SEQ ID NO: 748 - DNA, 69 bp, Artificial Sequence
  Description of Artificial Sequence: Synthetic oligonucleotide
aattctaatacgactcactataggtaatttctactaagtgtagatactcagggatgatgcgccacttcc

SEQ ID NO: 749 - DNA, 21 bp, Homo sapiens
ggaagtggcgccatcatccct

SEQ ID NO: 750 - DNA, 20 bp, Artificial Sequence
  Description of Artificial Sequence: Synthetic oligonucleotide
ggaagtggcgcatcatccct

SEQ ID NO: 751 - DNA, 28 bp, Artificial Sequence
  Description of Artificial Sequence: Synthetic oligonucleotide
tttgcccgggagcacttgtgggggttca

SEQ ID NO: 752 - DNA, 69 bp, Artificial Sequence
  Description of Artificial Sequence: Synthetic oligonucleotide
aattctaatacgactcactataggtaatttctactaagtgtagatcccgggagcacttgtgggggttca

SEQ ID NO: 753 - DNA, 21 bp, Homo sapiens
acttgtggggtttcatcaaga

SEQ ID NO: 754 - DNA, 21 bp, Artificial Sequence
  Description of Artificial Sequence: Synthetic oligonucleotide
acttgtgggggttcatcaaga

SEQ ID NO: 755 - DNA, 28 bp, Artificial Sequence
  Description of Artificial Sequence: Synthetic oligonucleotide
tttccattgcaactcccgccacgtgatt

SEQ ID NO: 756 - DNA, 69 bp, Artificial Sequence
  Description of Artificial Sequence: Synthetic oligonucleotide
aattctaatacgactcactataggtaatttctactaagtgtagatcattgcaactcccgccacgtgatt

SEQ ID NO: 757 - DNA, 21 bp, Homo sapiens
gggagttgcactggaaaacca

SEQ ID NO: 758 - DNA, 21 bp, Artificial Sequence
  Description of Artificial Sequence: Synthetic oligonucleotide
gggagttgcaatggaaaacca

SEQ ID NO: 759 - DNA, 28 bp, Artificial Sequence
  Description of Artificial Sequence: Synthetic oligonucleotide
ttttccattgcaactcccgccacgtgat

SEQ ID NO: 760 - DNA, 69 bp, Artificial Sequence
  Description of Artificial Sequence: Synthetic oligonucleotide
aattctaatacgactcactataggtaatttctactaagtgtagatccattgcaactcccgccacgtgat

SEQ ID NO: 761 - DNA, 28 bp, Artificial Sequence
  Description of Artificial Sequence: Synthetic oligonucleotide
tttgtttgaatttttgttgggggctgtg

SEQ ID NO: 762 - DNA, 69 bp, Artificial Sequence
  Description of Artificial Sequence: Synthetic oligonucleotide
aattctaatacgactcactataggtaatttctactaagtgtagattttgaatttttgttgggggctgtg

SEQ ID NO: 763 - DNA, 21 bp, Homo sapiens
actcactttggttgaattttt

SEQ ID NO: 764 - DNA, 21 bp, Artificial Sequence
  Description of Artificial Sequence: Synthetic oligonucleotide
actcactttgtttgaattttt

SEQ ID NO: 765 - DNA, 28 bp, Artificial Sequence
  Description of Artificial Sequence: Synthetic oligonucleotide
tttgaatttttgttgggggctgtggcgg

SEQ ID NO: 766 - DNA, 69 bp, Artificial Sequence
  Description of Artificial Sequence: Synthetic oligonucleotide
aattctaatacgactcactataggtaatttctactaagtgtagataatttttgttgggggctgtggcgg

SEQ ID NO: 767 - DNA, 28 bp, Artificial Sequence
  Description of Artificial Sequence: Synthetic oligonucleotide
tttttttgaatgtaacaacccagtttaa

SEQ ID NO: 768 - DNA, 69 bp, Artificial Sequence
  Description of Artificial Sequence: Synthetic oligonucleotide
aattctaatacgactcactataggtaatttctactaagtgtagattttgaatgtaacaacccagtttaa

SEQ ID NO: 769 - DNA, 20 bp, Homo sapiens
acttgccgcattttttgaat

SEQ ID NO: 770 - DNA, 21 bp, Artificial Sequence
  Description of Artificial Sequence: Synthetic oligonucleotide
acttgccgcatttttttgaat

SEQ ID NO: 771 - DNA, 28 bp, Artificial Sequence
  Description of Artificial Sequence: Synthetic oligonucleotide
tttctatggggaagtaagaaccagagac

SEQ ID NO: 772 - DNA, 69 bp, Artificial Sequence
  Description of Artificial Sequence: Synthetic oligonucleotide
aattctaatacgactcactataggtaatttctactaagtgtagattatggggaagtaagaaccagagac

SEQ ID NO: 773 - DNA, 21 bp, Homo sapiens
gggaagtaaggaccagagaca

SEQ ID NO: 774 - DNA, 21 bp, Artificial Sequence
  Description of Artificial Sequence: Synthetic oligonucleotide
gggaagtaagaaccagagaca

SEQ ID NO: 775 - DNA, 28 bp, Artificial Sequence
  Description of Artificial Sequence: Synthetic oligonucleotide
tttgtctctggttcttacttccccatag

SEQ ID NO: 776 - DNA, 69 bp, Artificial Sequence
  Description of Artificial Sequence: Synthetic oligonucleotide
aattctaatacgactcactataggtaatttctactaagtgtagattctctggttcttacttccccatag

SEQ ID NO: 777 - DNA, 28 bp, Artificial Sequence
  Description of Artificial Sequence: Synthetic oligonucleotide
tttttgtctctggttcttacttccccat

SEQ ID NO: 778 - DNA, 69 bp, Artificial Sequence
  Description of Artificial Sequence: Synthetic oligonucleotide
aattctaatacgactcactataggtaatttctactaagtgtagattgtctctggttcttacttccccat

SEQ ID NO: 779 - DNA, 28 bp, Artificial Sequence
  Description of Artificial Sequence: Synthetic oligonucleotide
ttttgtctctggttcttacttccccata

SEQ ID NO: 780 - DNA, 69 bp, Artificial Sequence
  Description of Artificial Sequence: Synthetic oligonucleotide
aattctaatacgactcactataggtaatttctactaagtgtagatgtctctggttcttacttccccata

SEQ ID NO: 781 - DNA, 28 bp, Artificial Sequence
  Description of Artificial Sequence: Synthetic oligonucleotide
tttcgttgtcatgacaatcactcaggag

SEQ ID NO: 782 - DNA, 69 bp, Artificial Sequence
  Description of Artificial Sequence: Synthetic oligonucleotide
aattctaatacgactcactataggtaatttctactaagtgtagatgttgtcatgacaatcactcaggag

SEQ ID NO: 783 - DNA, 21 bp, Homo sapiens
agaaaactcccgagtgattgt

SEQ ID NO: 784 - DNA, 21 bp, Artificial Sequence
  Description of Artificial Sequence: Synthetic oligonucleotide
agaaaactcctgagtgattgt

SEQ ID NO: 785 - DNA, 28 bp, Artificial Sequence
  Description of Artificial Sequence: Synthetic oligonucleotide
tttaggtaaggcttggatgggggaagat

SEQ ID NO: 786 - DNA, 69 bp, Artificial Sequence
  Description of Artificial Sequence: Synthetic oligonucleotide
aattctaatacgactcactataggtaatttctactaagtgtagatggtaaggcttggatgggggaagat

SEQ ID NO: 787 - DNA, 21 bp, Homo sapiens
ctggaggtttgggtaaggctt

SEQ ID NO: 788 - DNA, 21 bp, Artificial Sequence
  Description of Artificial Sequence: Synthetic oligonucleotide
ctggaggtttaggtaaggctt

SEQ ID NO: 789 - DNA, 28 bp, Artificial Sequence
  Description of Artificial Sequence: Synthetic oligonucleotide
tttatcttcccccatccaagccttacct

SEQ ID NO: 790 - DNA, 69 bp, Artificial Sequence
  Description of Artificial Sequence: Synthetic oligonucleotide
aattctaatacgactcactataggtaatttctactaagtgtagattcttcccccatccaagccttacct

SEQ ID NO: 791 - DNA, 28 bp, Artificial Sequence
  Description of Artificial Sequence: Synthetic oligonucleotide
tttgctgctggatcgtctcacacacact

SEQ ID NO: 792 - DNA, 69 bp, Artificial Sequence
  Description of Artificial Sequence: Synthetic oligonucleotide
aattctaatacgactcactataggtaatttctactaagtgtagatctgctggatcgtctcacacacact

SEQ ID NO: 793 - DNA, 21 bp, Homo sapiens
ctgctggatcatctcacacac

SEQ ID NO: 794 - DNA, 21 bp, Artificial Sequence
  Description of Artificial Sequence: Synthetic oligonucleotide
ctgctggatcgtctcacacac

SEQ ID NO: 795 - DNA, 28 bp, Artificial Sequence
  Description of Artificial Sequence: Synthetic oligonucleotide
ttttgctgctggatcgtctcacacacac

SEQ ID NO: 796 - DNA, 69 bp, Artificial Sequence
  Description of Artificial Sequence: Synthetic oligonucleotide
aattctaatacgactcactataggtaatttctactaagtgtagatgctgctggatcgtctcacacacac

SEQ ID NO: 797 - DNA, 28 bp, Artificial Sequence
  Description of Artificial Sequence: Synthetic oligonucleotide
tttagggtctgtggggcacaaaggtgaa

SEQ ID NO: 798 - DNA, 69 bp, Artificial Sequence
  Description of Artificial Sequence: Synthetic oligonucleotide
aattctaatacgactcactataggtaatttctactaagtgtagatgggtctgtggggcacaaaggtgaa

SEQ ID NO: 799 - DNA, 21 bp, Homo sapiens
tcacaatgttgagggtctgtg

SEQ ID NO: 800 - DNA, 21 bp, Artificial Sequence
  Description of Artificial Sequence: Synthetic oligonucleotide
tcacaatgtttagggtctgtg

SEQ ID NO: 801 - DNA, 28 bp, Artificial Sequence
  Description of Artificial Sequence: Synthetic oligonucleotide
tttgtgccccacagaccctaaacattgt

SEQ ID NO: 802 - DNA, 69 bp, Artificial Sequence
  Description of Artificial Sequence: Synthetic oligonucleotide
aattctaatacgactcactataggtaatttctactaagtgtagattgccccacagaccctaaacattgt

SEQ ID NO: 803 - DNA, 28 bp, Artificial Sequence
  Description of Artificial Sequence: Synthetic oligonucleotide
tttcatgactttgttcagccactgcctg

SEQ ID NO: 804 - DNA, 69 bp, Artificial Sequence
  Description of Artificial Sequence: Synthetic oligonucleotide
aattctaatacgactcactataggtaatttctactaagtgtagatatgactttgttcagccactgcctg

SEQ ID NO: 805 - DNA, 21 bp, Homo sapiens
cagtggctgatcaaagtcatg

SEQ ID NO: 806 - DNA, 21 bp, Artificial Sequence
  Description of Artificial Sequence: Synthetic oligonucleotide
cagtggctgaacaaagtcatg

SEQ ID NO: 807 - DNA, 28 bp, Artificial Sequence
  Description of Artificial Sequence: Synthetic oligonucleotide
tttgttcagccactgcctgacttagagt

SEQ ID NO: 808 - DNA, 69 bp, Artificial Sequence
  Description of Artificial Sequence: Synthetic oligonucleotide
aattctaatacgactcactataggtaatttctactaagtgtagatttcagccactgcctgacttagagt

SEQ ID NO: 809 - DNA, 28 bp, Artificial Sequence
  Description of Artificial Sequence: Synthetic oligonucleotide
tttacctgaagaatttcatgactttgtt

SEQ ID NO: 810 - DNA, 69 bp, Artificial Sequence
  Description of Artificial Sequence: Synthetic oligonucleotide
aattctaatacgactcactataggtaatttctactaagtgtagatcctgaagaatttcatgactttgtt

SEQ ID NO: 811 - DNA, 28 bp, Artificial Sequence
  Description of Artificial Sequence: Synthetic oligonucleotide
tttcttttttttttttttaatagctttt

SEQ ID NO: 812 - DNA, 69 bp, Artificial Sequence
  Description of Artificial Sequence: Synthetic oligonucleotide
aattctaatacgactcactataggtaatttctactaagtgtagatttttttttttttttaatagctttt

SEQ ID NO: 813 - DNA, 21 bp, Homo sapiens
agcgtgtaaagagctattaaa

SEQ ID NO: 814 - DNA, 21 bp, Artificial Sequence
  Description of Artificial Sequence: Synthetic oligonucleotide
agcgtgtaaaaagctattaaa

SEQ ID NO: 815 - DNA, 28 bp, Artificial Sequence
  Description of Artificial Sequence: Synthetic oligonucleotide
tttaatagctttttacacgctgtcttac

SEQ ID NO: 816 - DNA, 69 bp, Artificial Sequence
  Description of Artificial Sequence: Synthetic oligonucleotide
aattctaatacgactcactataggtaatttctactaagtgtagatatagctttttacacgctgtcttac

SEQ ID NO: 817 - DNA, 28 bp, Artificial Sequence
  Description of Artificial Sequence: Synthetic oligonucleotide
tttttcttttttttttttttaatagctt

SEQ ID NO: 818 - DNA, 69 bp, Artificial Sequence
  Description of Artificial Sequence: Synthetic oligonucleotide
aattctaatacgactcactataggtaatttctactaagtgtagattcttttttttttttttaatagctt

SEQ ID NO: 819 - DNA, 28 bp, Artificial Sequence
  Description of Artificial Sequence: Synthetic oligonucleotide
ttttcttttttttttttttaatagcttt

SEQ ID NO: 820 - DNA, 69 bp, Artificial Sequence
  Description of Artificial Sequence: Synthetic oligonucleotide
aattctaatacgactcactataggtaatttctactaagtgtagatcttttttttttttttaatagcttt

SEQ ID NO: 821 - DNA, 28 bp, Artificial Sequence
  Description of Artificial Sequence: Synthetic oligonucleotide
ttttttttttttttaatagctttttaca

SEQ ID NO: 822 - DNA, 69 bp, Artificial Sequence
  Description of Artificial Sequence: Synthetic oligonucleotide
aattctaatacgactcactataggtaatttctactaagtgtagatttttttttttaatagctttttaca

SEQ ID NO: 823 - DNA, 28 bp, Artificial Sequence
  Description of Artificial Sequence: Synthetic oligonucleotide
tttttttttttttaatagctttttacac

SEQ ID NO: 824 - DNA, 69 bp, Artificial Sequence
  Description of Artificial Sequence: Synthetic oligonucleotide
aattctaatacgactcactataggtaatttctactaagtgtagattttttttttaatagctttttacac

SEQ ID NO: 825 - DNA, 28 bp, Artificial Sequence
  Description of Artificial Sequence: Synthetic oligonucleotide
ttttttttttttaatagctttttacacg

SEQ ID NO: 826 - DNA, 69 bp, Artificial Sequence
  Description of Artificial Sequence: Synthetic oligonucleotide
aattctaatacgactcactataggtaatttctactaagtgtagatttttttttaatagctttttacacg

SEQ ID NO: 827 - DNA, 28 bp, Artificial Sequence
  Description of Artificial Sequence: Synthetic oligonucleotide
tttttttttttaatagctttttacacgc

SEQ ID NO: 828 - DNA, 69 bp, Artificial Sequence
  Description of Artificial Sequence: Synthetic oligonucleotide
aattctaatacgactcactataggtaatttctactaagtgtagattttttttaatagctttttacacgc

SEQ ID NO: 829 - DNA, 28 bp, Artificial Sequence
  Description of Artificial Sequence: Synthetic oligonucleotide
ttttttttttaatagctttttacacgct

SEQ ID NO: 830 - DNA, 69 bp, Artificial Sequence
  Description of Artificial Sequence: Synthetic oligonucleotide
aattctaatacgactcactataggtaatttctactaagtgtagatttttttaatagctttttacacgct

SEQ ID NO: 831 - DNA, 28 bp, Artificial Sequence
  Description of Artificial Sequence: Synthetic oligonucleotide
tttttttttaatagctttttacacgctg

SEQ ID NO: 832 - DNA, 69 bp, Artificial Sequence
  Description of Artificial Sequence: Synthetic oligonucleotide
aattctaatacgactcactataggtaatttctactaagtgtagattttttaatagctttttacacgctg

SEQ ID NO: 833 - DNA, 28 bp, Artificial Sequence
  Description of Artificial Sequence: Synthetic oligonucleotide
ttttttttaatagctttttacacgctgt

SEQ ID NO: 834 - DNA, 69 bp, Artificial Sequence
  Description of Artificial Sequence: Synthetic oligonucleotide
aattctaatacgactcactataggtaatttctactaagtgtagatttttaatagctttttacacgctgt

SEQ ID NO: 835 - DNA, 28 bp, Artificial Sequence
  Description of Artificial Sequence: Synthetic oligonucleotide
tttttttaatagctttttacacgctgtc

SEQ ID NO: 836 - DNA, 69 bp, Artificial Sequence
  Description of Artificial Sequence: Synthetic oligonucleotide
aattctaatacgactcactataggtaatttctactaagtgtagattttaatagctttttacacgctgtc

SEQ ID NO: 837 - DNA, 28 bp, Artificial Sequence
  Description of Artificial Sequence: Synthetic oligonucleotide
ttttttaatagctttttacacgctgtct

SEQ ID NO: 838 - DNA, 69 bp, Artificial Sequence
  Description of Artificial Sequence: Synthetic oligonucleotide
aattctaatacgactcactataggtaatttctactaagtgtagatttaatagctttttacacgctgtct

SEQ ID NO: 839 - DNA, 28 bp, Artificial Sequence
  Description of Artificial Sequence: Synthetic oligonucleotide
tttttaatagctttttacacgctgtctt

SEQ ID NO: 840 - DNA, 69 bp, Artificial Sequence
  Description of Artificial Sequence: Synthetic oligonucleotide
aattctaatacgactcactataggtaatttctactaagtgtagattaatagctttttacacgctgtctt

SEQ ID NO: 841 - DNA, 28 bp, Artificial Sequence
  Description of Artificial Sequence: Synthetic oligonucleotide
ttttaatagctttttacacgctgtctta

SEQ ID NO: 842 - DNA, 69 bp, Artificial Sequence
  Description of Artificial Sequence: Synthetic oligonucleotide
aattctaatacgactcactataggtaatttctactaagtgtagataatagctttttacacgctgtctta

SEQ ID NO: 843 - DNA, 28 bp, Artificial Sequence
  Description of Artificial Sequence: Synthetic oligonucleotide
tttttacacgctgtcttacaccgcttgt

SEQ ID NO: 844 - DNA, 69 bp, Artificial Sequence
  Description of Artificial Sequence: Synthetic oligonucleotide
aattctaatacgactcactataggtaatttctactaagtgtagattacacgctgtcttacaccgcttgt

SEQ ID NO: 845 - DNA, 28 bp, Artificial Sequence
  Description of Artificial Sequence: Synthetic oligonucleotide
ttttacacgctgtcttacaccgcttgta

SEQ ID NO: 846 - DNA, 69 bp, Artificial Sequence
  Description of Artificial Sequence: Synthetic oligonucleotide
aattctaatacgactcactataggtaatttctactaagtgtagatacacgctgtcttacaccgcttgta

SEQ ID NO: 847 - DNA, 28 bp, Artificial Sequence
  Description of Artificial Sequence: Synthetic oligonucleotide
tttccaagaaccaagctcttccgaggga

SEQ ID NO: 848 - DNA, 69 bp, Artificial Sequence
  Description of Artificial Sequence: Synthetic oligonucleotide
aattctaatacgactcactataggtaatttctactaagtgtagatcaagaaccaagctcttccgaggga

SEQ ID NO: 849 - DNA, 21 bp, Homo sapiens
cctcggaagaacttggttctt

SEQ ID NO: 850 - DNA, 21 bp, Artificial Sequence
  Description of Artificial Sequence: Synthetic oligonucleotide
cctcggaagagcttggttctt

SEQ ID NO: 851 - DNA, 28 bp, Artificial Sequence
  Description of Artificial Sequence: Synthetic oligonucleotide
tttttccaagaaccaagctcttccgagg

SEQ ID NO: 852 - DNA, 69 bp, Artificial Sequence
  Description of Artificial Sequence: Synthetic oligonucleotide
aattctaatacgactcactataggtaatttctactaagtgtagattccaagaaccaagctcttccgagg

SEQ ID NO: 853 - DNA, 28 bp, Artificial Sequence
  Description of Artificial Sequence: Synthetic oligonucleotide
ttttccaagaaccaagctcttccgaggg

SEQ ID NO: 854 - DNA, 69 bp, Artificial Sequence
  Description of Artificial Sequence: Synthetic oligonucleotide
aattctaatacgactcactataggtaatttctactaagtgtagatccaagaaccaagctcttccgaggg

SEQ ID NO: 855 - DNA, 28 bp, Artificial Sequence
  Description of Artificial Sequence: Synthetic oligonucleotide
tttggttcttgtacacaaactacatcag

SEQ ID NO: 856 - DNA, 69 bp, Artificial Sequence
  Description of Artificial Sequence: Synthetic oligonucleotide
aattctaatacgactcactataggtaatttctactaagtgtagatgttcttgtacacaaactacatcag

SEQ ID NO: 857 - DNA, 21 bp, Homo sapiens
tacacaaactccatcagcttc

SEQ ID NO: 858 - DNA, 21 bp, Artificial Sequence
  Description of Artificial Sequence: Synthetic oligonucleotide
tacacaaactacatcagcttc

SEQ ID NO: 859 - DNA, 28 bp, Artificial Sequence
  Description of Artificial Sequence: Synthetic oligonucleotide
ttttggttcttgtacacaaactacatca

SEQ ID NO: 860 - DNA, 69 bp, Artificial Sequence
  Description of Artificial Sequence: Synthetic oligonucleotide
aattctaatacgactcactataggtaatttctactaagtgtagatggttcttgtacacaaactacatca

SEQ ID NO: 861 - DNA, 28 bp, Artificial Sequence
  Description of Artificial Sequence: Synthetic oligonucleotide
tttcttcttattttagataaatcgtttc

SEQ ID NO: 862 - DNA, 69 bp, Artificial Sequence
  Description of Artificial Sequence: Synthetic oligonucleotide
aattctaatacgactcactataggtaatttctactaagtgtagatttcttattttagataaatcgtttc

SEQ ID NO: 863 - DNA, 21 bp, Homo sapiens
gacagaaacgctttatctaaa

SEQ ID NO: 864 - DNA, 21 bp, Artificial Sequence
  Description of Artificial Sequence: Synthetic oligonucleotide
gacagaaacgatttatctaaa

SEQ ID NO: 865 - DNA, 28 bp, Artificial Sequence
  Description of Artificial Sequence: Synthetic oligonucleotide
tttggtttcttcttattttagataaatc

SEQ ID NO: 866 - DNA, 69 bp, Artificial Sequence
  Description of Artificial Sequence: Synthetic oligonucleotide
aattctaatacgactcactataggtaatttctactaagtgtagatgtttcttcttattttagataaatc

SEQ ID NO: 867 - DNA, 28 bp, Artificial Sequence
  Description of Artificial Sequence: Synthetic oligonucleotide
tttagataaatcgtttctgtctctagct

SEQ ID NO: 868 - DNA, 69 bp, Artificial Sequence
  Description of Artificial Sequence: Synthetic oligonucleotide
aattctaatacgactcactataggtaatttctactaagtgtagatgataaatcgtttctgtctctagct

SEQ ID NO: 869 - DNA, 28 bp, Artificial Sequence
  Description of Artificial Sequence: Synthetic oligonucleotide
ttttggtttcttcttattttagataaat

SEQ ID NO: 870 - DNA, 69 bp, Artificial Sequence
  Description of Artificial Sequence: Synthetic oligonucleotide
aattctaatacgactcactataggtaatttctactaagtgtagatggtttcttcttattttagataaat

SEQ ID NO: 871 - DNA, 28 bp, Artificial Sequence
  Description of Artificial Sequence: Synthetic oligonucleotide
ttttagataaatcgtttctgtctctagc

SEQ ID NO: 872 - DNA, 69 bp, Artificial Sequence
  Description of Artificial Sequence: Synthetic oligonucleotide
aattctaatacgactcactataggtaatttctactaagtgtagatagataaatcgtttctgtctctagc

SEQ ID NO: 873 - DNA, 28 bp, Artificial Sequence
  Description of Artificial Sequence: Synthetic oligonucleotide
tttcttgttggtatttttgttggtaaca

SEQ ID NO: 874 - DNA, 69 bp, Artificial Sequence
  Description of Artificial Sequence: Synthetic oligonucleotide
aattctaatacgactcactataggtaatttctactaagtgtagatttgttggtatttttgttggtaaca

SEQ ID NO: 875 - DNA, 21 bp, Homo sapiens
tggtatttttcttggtaacac

SEQ ID NO: 876 - DNA, 21 bp, Artificial Sequence
  Description of Artificial Sequence: Synthetic oligonucleotide
tggtatttttgttggtaacac

SEQ ID NO: 877 - DNA, 28 bp, Artificial Sequence
  Description of Artificial Sequence: Synthetic oligonucleotide
tttgttggtaacactaggactaatttcc

SEQ ID NO: 878 - DNA, 69 bp, Artificial Sequence
  Description of Artificial Sequence: Synthetic oligonucleotide
aattctaatacgactcactataggtaatttctactaagtgtagatttggtaacactaggactaatttcc

SEQ ID NO: 879 - DNA, 28 bp, Artificial Sequence
  Description of Artificial Sequence: Synthetic oligonucleotide
ttttcttgttggtatttttgttggtaac

SEQ ID NO: 880 - DNA, 69 bp, Artificial Sequence
  Description of Artificial Sequence: Synthetic oligonucleotide
aattctaatacgactcactataggtaatttctactaagtgtagatcttgttggtatttttgttggtaac

SEQ ID NO: 881 - DNA, 28 bp, Artificial Sequence
  Description of Artificial Sequence: Synthetic oligonucleotide
tttttgttggtaacactaggactaattt

SEQ ID NO: 882 - DNA, 69 bp, Artificial Sequence
  Description of Artificial Sequence: Synthetic oligonucleotide
aattctaatacgactcactataggtaatttctactaagtgtagattgttggtaacactaggactaattt

SEQ ID NO: 883 - DNA, 28 bp, Artificial Sequence
  Description of Artificial Sequence: Synthetic oligonucleotide
ttttgttggtaacactaggactaatttc

SEQ ID NO: 884 - DNA, 69 bp, Artificial Sequence
  Description of Artificial Sequence: Synthetic oligonucleotide
aattctaatacgactcactataggtaatttctactaagtgtagatgttggtaacactaggactaatttc

SEQ ID NO: 885 - DNA, 28 bp, Artificial Sequence
  Description of Artificial Sequence: Synthetic oligonucleotide
tttctttatggggctttcaggcagacat

SEQ ID NO: 886 - DNA, 69 bp, Artificial Sequence
  Description of Artificial Sequence: Synthetic oligonucleotide
aattctaatacgactcactataggtaatttctactaagtgtagattttatggggctttcaggcagacat

SEQ ID NO: 887 - DNA, 21 bp, Homo sapiens
aaagccccatgaagaaaaata

SEQ ID NO: 888 - DNA, 21 bp, Artificial Sequence
  Description of Artificial Sequence: Synthetic oligonucleotide
aaagccccataaagaaaaata

SEQ ID NO: 889 - DNA, 28 bp, Artificial Sequence
  Description of Artificial Sequence: Synthetic oligonucleotide
tttatttttctttatggggctttcaggc

SEQ ID NO: 890 - DNA, 69 bp, Artificial Sequence
  Description of Artificial Sequence: Synthetic oligonucleotide
aattctaatacgactcactataggtaatttctactaagtgtagattttttctttatggggctttcaggc

SEQ ID NO: 891 - DNA, 28 bp, Artificial Sequence
  Description of Artificial Sequence: Synthetic oligonucleotide
tttatggggctttcaggcagacatcagg

SEQ ID NO: 892 - DNA, 69 bp, Artificial Sequence
  Description of Artificial Sequence: Synthetic oligonucleotide
aattctaatacgactcactataggtaatttctactaagtgtagattggggctttcaggcagacatcagg

SEQ ID NO: 893 - DNA, 28 bp, Artificial Sequence
  Description of Artificial Sequence: Synthetic oligonucleotide
ttttatttttctttatggggctttcagg

SEQ ID NO: 894 - DNA, 69 bp, Artificial Sequence
  Description of Artificial Sequence: Synthetic oligonucleotide
aattctaatacgactcactataggtaatttctactaagtgtagatatttttctttatggggctttcagg

SEQ ID NO: 895 - DNA, 28 bp, Artificial Sequence
  Description of Artificial Sequence: Synthetic oligonucleotide
tttttctttatggggctttcaggcagac

SEQ ID NO: 896 - DNA, 69 bp, Artificial Sequence
  Description of Artificial Sequence: Synthetic oligonucleotide
aattctaatacgactcactataggtaatttctactaagtgtagattctttatggggctttcaggcagac

SEQ ID NO: 897 - DNA, 28 bp, Artificial Sequence
  Description of Artificial Sequence: Synthetic oligonucleotide
ttttctttatggggctttcaggcagaca

SEQ ID NO: 898 - DNA, 69 bp, Artificial Sequence
  Description of Artificial Sequence: Synthetic oligonucleotide
aattctaatacgactcactataggtaatttctactaagtgtagatctttatggggctttcaggcagaca

SEQ ID NO: 899 - DNA, 28 bp, Artificial Sequence
  Description of Artificial Sequence: Synthetic oligonucleotide
tttggagaggctggtgtccctgtacaac

SEQ ID NO: 900 - DNA, 69 bp, Artificial Sequence
  Description of Artificial Sequence: Synthetic oligonucleotide
aattctaatacgactcactataggtaatttctactaagtgtagatgagaggctggtgtccctgtacaac

SEQ ID NO: 901 - DNA, 21 bp, Homo sapiens
aggtttggagtggctggtgtc

SEQ ID NO: 902 - DNA, 21 bp, Artificial Sequence
  Description of Artificial Sequence: Synthetic oligonucleotide
aggtttggagaggctggtgtc

SEQ ID NO: 903 - DNA, 28 bp, Artificial Sequence
  Description of Artificial Sequence: Synthetic oligonucleotide
tttctgcccagtgcaccggccccagtgg

SEQ ID NO: 904 - DNA, 69 bp, Artificial Sequence
  Description of Artificial Sequence: Synthetic oligonucleotide
aattctaatacgactcactataggtaatttctactaagtgtagattgcccagtgcaccggccccagtgg

SEQ ID NO: 905 - DNA, 21 bp, Homo sapiens
caccggcccccgtggcatggg

SEQ ID NO: 906 - DNA, 21 bp, Artificial Sequence
  Description of Artificial Sequence: Synthetic oligonucleotide
caccggccccagtggcatggg

SEQ ID NO: 907 - DNA, 28 bp, Artificial Sequence
  Description of Artificial Sequence: Synthetic oligonucleotide
tttgtctccatgggagtggaaggcgcct

SEQ ID NO: 908 - DNA, 69 bp, Artificial Sequence
  Description of Artificial Sequence: Synthetic oligonucleotide
aattctaatacgactcactataggtaatttctactaagtgtagattctccatgggagtggaaggcgcct

SEQ ID NO: 909 - DNA, 21 bp, Homo sapiens
tttgtctccacgggagtggaa

SEQ ID NO: 910 - DNA, 21 bp, Artificial Sequence
  Description of Artificial Sequence: Synthetic oligonucleotide
tttgtctccatgggagtggaa

SEQ ID NO: 911 - DNA, 28 bp, Artificial Sequence
  Description of Artificial Sequence: Synthetic oligonucleotide
tttcttggcttaccccgaagttacatct

SEQ ID NO: 912 - DNA, 69 bp, Artificial Sequence
  Description of Artificial Sequence: Synthetic oligonucleotide
aattctaatacgactcactataggtaatttctactaagtgtagatttggcttaccccgaagttacatct

SEQ ID NO: 913 - DNA, 21 bp, Homo sapiens
tggagaaagacgtaacttcgg

SEQ ID NO: 914 - DNA, 21 bp, Artificial Sequence
  Description of Artificial Sequence: Synthetic oligonucleotide
tggagaaagatgtaacttcgg

SEQ ID NO: 915 - DNA, 28 bp, Artificial Sequence
  Description of Artificial Sequence: Synthetic oligonucleotide
tttagcattgcagctcgtttactggcat

SEQ ID NO: 916 - DNA, 69 bp, Artificial Sequence
  Description of Artificial Sequence: Synthetic oligonucleotide
aattctaatacgactcactataggtaatttctactaagtgtagatgcattgcagctcgtttactggcat

SEQ ID NO: 917 - DNA, 21 bp, Homo sapiens
gccagtaaactagctgcaatg

SEQ ID NO: 918 - DNA, 21 bp, Artificial Sequence
  Description of Artificial Sequence: Synthetic oligonucleotide
gccagtaaacgagctgcaatg

SEQ ID NO: 919 - DNA, 28 bp, Artificial Sequence
  Description of Artificial Sequence: Synthetic oligonucleotide
tttcttaatccacaatgctgtaagccta

SEQ ID NO: 920 - DNA, 69 bp, Artificial Sequence
  Description of Artificial Sequence: Synthetic oligonucleotide
aattctaatacgactcactataggtaatttctactaagtgtagatttaatccacaatgctgtaagccta

SEQ ID NO: 921 - DNA, 21 bp, Homo sapiens
tacagcattgcggattaagaa

SEQ ID NO: 922 - DNA, 21 bp, Artificial Sequence
  Description of Artificial Sequence: Synthetic oligonucleotide
tacagcattgtggattaagaa

SEQ ID NO: 923 - DNA, 28 bp, Artificial Sequence
  Description of Artificial Sequence: Synthetic oligonucleotide
ttttcttaatccacaatgctgtaagcct

SEQ ID NO: 924 - DNA, 69 bp, Artificial Sequence
  Description of Artificial Sequence: Synthetic oligonucleotide
aattctaatacgactcactataggtaatttctactaagtgtagatcttaatccacaatgctgtaagcct

SEQ ID NO: 925 - DNA, 28 bp, Artificial Sequence
  Description of Artificial Sequence: Synthetic oligonucleotide
tttgaaatcaaagagtatcttggtaaag

SEQ ID NO: 926 - DNA, 69 bp, Artificial Sequence
  Description of Artificial Sequence: Synthetic oligonucleotide
aattctaatacgactcactataggtaatttctactaagtgtagataaatcaaagagtatcttggtaaag

SEQ ID NO: 927 - DNA, 21 bp, Homo sapiens
aaatcaaagaatatcttggta

SEQ ID NO: 928 - DNA, 21 bp, Artificial Sequence
  Description of Artificial Sequence: Synthetic oligonucleotide
aaatcaaagagtatcttggta

SEQ ID NO: 929 - DNA, 28 bp, Artificial Sequence
  Description of Artificial Sequence: Synthetic oligonucleotide
tttaccaagatactctttgatttcaaat

SEQ ID NO: 930 - DNA, 69 bp, Artificial Sequence
  Description of Artificial Sequence: Synthetic oligonucleotide
aattctaatacgactcactataggtaatttctactaagtgtagatccaagatactctttgatttcaaat

SEQ ID NO: 931 - DNA, 28 bp, Artificial Sequence
  Description of Artificial Sequence: Synthetic oligonucleotide
tttacagacaatggtacttggacttagc

SEQ ID NO: 932 - DNA, 69 bp, Artificial Sequence
  Description of Artificial Sequence: Synthetic oligonucleotide
aattctaatacgactcactataggtaatttctactaagtgtagatcagacaatggtacttggacttagc

SEQ ID NO: 933 - DNA, 21 bp, Homo sapiens
tacttggactcagctctggtt

SEQ ID NO: 934 - DNA, 21 bp, Artificial Sequence
  Description of Artificial Sequence: Synthetic oligonucleotide
tacttggacttagctctggtt

SEQ ID NO: 935 - DNA, 28 bp, Artificial Sequence
  Description of Artificial Sequence: Synthetic oligonucleotide
ttttacagacaatggtacttggacttag

SEQ ID NO: 936 - DNA, 69 bp, Artificial Sequence
  Description of Artificial Sequence: Synthetic oligonucleotide
aattctaatacgactcactataggtaatttctactaagtgtagatacagacaatggtacttggacttag

SEQ ID NO: 937 - DNA, 28 bp, Artificial Sequence
  Description of Artificial Sequence: Synthetic oligonucleotide
ttttcgacatattgtggtggtgccctat

SEQ ID NO: 938 - DNA, 69 bp, Artificial Sequence
  Description of Artificial Sequence: Synthetic oligonucleotide
aattctaatacgactcactataggtaatttctactaagtgtagatcgacatattgtggtggtgccctat

SEQ ID NO: 939 - DNA, 28 bp, Artificial Sequence
  Description of Artificial Sequence: Synthetic oligonucleotide
tttgaggtgcatgtttgtgcctgtcctg

SEQ ID NO: 940 - DNA, 69 bp, Artificial Sequence
  Description of Artificial Sequence: Synthetic oligonucleotide
aattctaatacgactcactataggtaatttctactaagtgtagataggtgcatgtttgtgcctgtcctg

SEQ ID NO: 941 - DNA, 21 bp, Homo sapiens
ggcacaaacacgcacctcaaa

SEQ ID NO: 942 - DNA, 21 bp, Artificial Sequence
  Description of Artificial Sequence: Synthetic oligonucleotide
ggcacaaacatgcacctcaaa

SEQ ID NO: 943 - DNA, 28 bp, Artificial Sequence
  Description of Artificial Sequence: Synthetic oligonucleotide
tttcgacatagtgtggtgccctatgagc

SEQ ID NO: 944 - DNA, 69 bp, Artificial Sequence
  Description of Artificial Sequence: Synthetic oligonucleotide
aattctaatacgactcactataggtaatttctactaagtgtagatgacatagtgtggtgccctatgagc

SEQ ID NO: 945 - DNA, 23 bp, Homo sapiens
gctcatagggcaccaccacacta

SEQ ID NO: 946 - DNA, 20 bp, Artificial Sequence
  Description of Artificial Sequence: Synthetic oligonucleotide
gctcatagggcaccacacta

SEQ ID NO: 947 - DNA, 28 bp, Artificial Sequence
  Description of Artificial Sequence: Synthetic oligonucleotide
ttttcgacatagtgtggtgccctatgag

SEQ ID NO: 948 - DNA, 69 bp, Artificial Sequence
  Description of Artificial Sequence: Synthetic oligonucleotide
aattctaatacgactcactataggtaatttctactaagtgtagatcgacatagtgtggtgccctatgag

SEQ ID NO: 949 - DNA, 28 bp, Artificial Sequence
  Description of Artificial Sequence: Synthetic oligonucleotide
tttccttccactcggataagatgctgag

SEQ ID NO: 950 - DNA, 69 bp, Artificial Sequence
  Description of Artificial Sequence: Synthetic oligonucleotide
aattctaatacgactcactataggtaatttctactaagtgtagatcttccactcggataagatgctgag

SEQ ID NO: 951 - DNA, 23 bp, Homo sapiens
ataagatgctgaggaggggccag

SEQ ID NO: 952 - DNA, 20 bp, Artificial Sequence
  Description of Artificial Sequence: Synthetic oligonucleotide
ataagatgctgaggggccag

SEQ ID NO: 953 - DNA, 28 bp, Artificial Sequence
  Description of Artificial Sequence: Synthetic oligonucleotide
tttgctggctggaaaggggtgactcgct

SEQ ID NO: 954 - DNA, 69 bp, Artificial Sequence
  Description of Artificial Sequence: Synthetic oligonucleotide
aattctaatacgactcactataggtaatttctactaagtgtagatctggctggaaaggggtgactcgct

SEQ ID NO: 955 - DNA, 21 bp, Homo sapiens
atggccagagtgagtcacccc

SEQ ID NO: 956 - DNA, 21 bp, Artificial Sequence
  Description of Artificial Sequence: Synthetic oligonucleotide
atggccagagcgagtcacccc

SEQ ID NO: 957 - DNA, 28 bp, Artificial Sequence
  Description of Artificial Sequence: Synthetic oligonucleotide
tttatggtttcggaggcccgaccggggc

SEQ ID NO: 958 - DNA, 69 bp, Artificial Sequence
  Description of Artificial Sequence: Synthetic oligonucleotide
aattctaatacgactcactataggtaatttctactaagtgtagattggtttcggaggcccgaccggggc

SEQ ID NO: 959 - DNA, 21 bp, Homo sapiens
ccgaaaccatgaactttctgc

SEQ ID NO: 960 - DNA, 21 bp, Artificial Sequence
  Description of Artificial Sequence: Synthetic oligonucleotide
ccgaaaccataaactttctgc

SEQ ID NO: 961 - DNA, 28 bp, Artificial Sequence
  Description of Artificial Sequence: Synthetic oligonucleotide
tttcaagaaaaaatttttatgtcttaat

SEQ ID NO: 962 - DNA, 69 bp, Artificial Sequence
  Description of Artificial Sequence: Synthetic oligonucleotide
aattctaatacgactcactataggtaatttctactaagtgtagataagaaaaaatttttatgtcttaat

SEQ ID NO: 963 - DNA, 20 bp, Homo sapiens
tactttcaagaaaaattttt

SEQ ID NO: 964 - DNA, 21 bp, Artificial Sequence
  Description of Artificial Sequence: Synthetic oligonucleotide
tactttcaagaaaaaattttt

SEQ ID NO: 965 - DNA, 28 bp, Artificial Sequence
  Description of Artificial Sequence: Synthetic oligonucleotide
tttcttgaaagtaatgactgtgtagcac

SEQ ID NO: 966 - DNA, 69 bp, Artificial Sequence
  Description of Artificial Sequence: Synthetic oligonucleotide
aattctaatacgactcactataggtaatttctactaagtgtagatttgaaagtaatgactgtgtagcac

SEQ ID NO: 967 - DNA, 28 bp, Artificial Sequence
  Description of Artificial Sequence: Synthetic oligonucleotide
ttttttcttgaaagtaatgactgtgtag

SEQ ID NO: 968 - DNA, 69 bp, Artificial Sequence
  Description of Artificial Sequence: Synthetic oligonucleotide
aattctaatacgactcactataggtaatttctactaagtgtagatttcttgaaagtaatgactgtgtag

SEQ ID NO: 969 - DNA, 28 bp, Artificial Sequence
  Description of Artificial Sequence: Synthetic oligonucleotide
tttttcttgaaagtaatgactgtgtagc

SEQ ID NO: 970 - DNA, 69 bp, Artificial Sequence
  Description of Artificial Sequence: Synthetic oligonucleotide
aattctaatacgactcactataggtaatttctactaagtgtagattcttgaaagtaatgactgtgtagc

SEQ ID NO: 971 - DNA, 28 bp, Artificial Sequence
  Description of Artificial Sequence: Synthetic oligonucleotide
ttttcttgaaagtaatgactgtgtagca

SEQ ID NO: 972 - DNA, 69 bp, Artificial Sequence
  Description of Artificial Sequence: Synthetic oligonucleotide
aattctaatacgactcactataggtaatttctactaagtgtagatcttgaaagtaatgactgtgtagca

SEQ ID NO: 973 - DNA, 28 bp, Artificial Sequence
  Description of Artificial Sequence: Synthetic oligonucleotide
tttcaactatgtcagtttgtaatggtaa

SEQ ID NO: 974 - DNA, 69 bp, Artificial Sequence
  Description of Artificial Sequence: Synthetic oligonucleotide
aattctaatacgactcactataggtaatttctactaagtgtagataactatgtcagtttgtaatggtaa

SEQ ID NO: 975 - DNA, 21 bp, Homo sapiens
caaactgacacagttgaaata

SEQ ID NO: 976 - DNA, 21 bp, Artificial Sequence
  Description of Artificial Sequence: Synthetic oligonucleotide
caaactgacatagttgaaata

SEQ ID NO: 977 - DNA, 28 bp, Artificial Sequence
  Description of Artificial Sequence: Synthetic oligonucleotide
tttggagatatgctgttgggaaacgata

SEQ ID NO: 978 - DNA, 69 bp, Artificial Sequence
  Description of Artificial Sequence: Synthetic oligonucleotide
aattctaatacgactcactataggtaatttctactaagtgtagatgagatatgctgttgggaaacgata

SEQ ID NO: 979 - DNA, 21 bp, Homo sapiens
tgttgggaaaagatatggtca

SEQ ID NO: 980 - DNA, 21 bp, Artificial Sequence
  Description of Artificial Sequence: Synthetic oligonucleotide
tgttgggaaacgatatggtca

SEQ ID NO: 981 - DNA, 28 bp, Artificial Sequence
  Description of Artificial Sequence: Synthetic oligonucleotide
tttgggaccctccaccgggctcgcctgt

SEQ ID NO: 982 - DNA, 69 bp, Artificial Sequence
  Description of Artificial Sequence: Synthetic oligonucleotide
aattctaatacgactcactataggtaatttctactaagtgtagatggaccctccaccgggctcgcctgt

SEQ ID NO: 983 - DNA, 21 bp, Homo sapiens
cgggctcgccggtccgtcgga

SEQ ID NO: 984 - DNA, 21 bp, Artificial Sequence
  Description of Artificial Sequence: Synthetic oligonucleotide
cgggctcgcctgtccgtcgga

SEQ ID NO: 985 - DNA, 23 bp, Artificial Sequence
  Description of Artificial Sequence: Synthetic oligonucleotide
tgctcctgccttttcctcactgg

SEQ ID NO: 986 - DNA, 119 bp, Artificial Sequence
  Description of Artificial Sequence: Synthetic polynucleotide
attctaatacgactcactataggtgctcctgccttttcctcacgttttagagctagaaatagcaagttaaaataaggctagtccgttatcaacttgaaaaagtggcaccgagtcggtgc

SEQ ID NO: 987 - DNA, 23 bp, Artificial Sequence
  Description of Artificial Sequence: Synthetic oligonucleotide
cgctgaagccagtgaggaaaagg

SEQ ID NO: 988 - DNA, 119 bp, Artificial Sequence
  Description of Artificial Sequence: Synthetic polynucleotide
attctaatacgactcactataggcgctgaagccagtgaggaaagttttagagctagaaatagcaagttaaaataaggctagtccgttatcaacttgaaaaagtggcaccgagtcggtgc

SEQ ID NO: 989 - DNA, 23 bp, Artificial Sequence
  Description of Artificial Sequence: Synthetic oligonucleotide
gaagccagtgaggaaaaggcagg

SEQ ID NO: 990 - DNA, 119 bp, Artificial Sequence
  Description of Artificial Sequence: Synthetic polynucleotide
attctaatacgactcactatagggaagccagtgaggaaaaggcgttttagagctagaaatagcaagttaaaataaggctagtccgttatcaacttgaaaaagtggcaccgagtcggtgc

SEQ ID NO: 991 - DNA, 23 bp, Artificial Sequence
  Description of Artificial Sequence: Synthetic oligonucleotide
tgaggaaaaggcaggagcacagg

SEQ ID NO: 992 - DNA, 119 bp, Artificial Sequence
  Description of Artificial Sequence: Synthetic polynucleotide
attctaatacgactcactataggtgaggaaaaggcaggagcacgttttagagctagaaatagcaagttaaaataaggctagtccgttatcaacttgaaaaagtggcaccgagtcggtgc

SEQ ID NO: 993 - DNA, 23 bp, Artificial Sequence
  Description of Artificial Sequence: Synthetic oligonucleotide
gaccctcctccagcggctccagg

SEQ ID NO: 994 - DNA, 119 bp, Artificial Sequence
  Description of Artificial Sequence: Synthetic polynucleotide
attctaatacgactcactatagggaccctcctccagcggctccgttttagagctagaaatagcaagttaaaataaggctagtccgttatcaacttgaaaaagtggcaccgagtcggtgc

SEQ ID NO: 995 - DNA, 21 bp, Homo sapiens
agggaccctcgtccagcggct

SEQ ID NO: 996 - DNA, 21 bp, Artificial Sequence
  Description of Artificial Sequence: Synthetic oligonucleotide
agggaccctcctccagcggct

SEQ ID NO: 997 - DNA, 23 bp, Artificial Sequence
  Description of Artificial Sequence: Synthetic oligonucleotide
ctccagcggctccaggtagctgg

SEQ ID NO: 998 - DNA, 119 bp, Artificial Sequence
  Description of Artificial Sequence: Synthetic polynucleotide
attctaatacgactcactataggctccagcggctccaggtagcgttttagagctagaaatagcaagttaaaataaggctagtccgttatcaacttgaaaaagtggcaccgagtcggtgc

SEQ ID NO: 999 - DNA, 23 bp, Artificial Sequence
  Description of Artificial Sequence: Synthetic oligonucleotide
ctgaagggaccctcctccagcgg

SEQ ID NO: 1000 - DNA, 119 bp, Artificial Sequence
  Description of Artificial Sequence: Synthetic polynucleotide
attctaatacgactcactataggctgaagggaccctcctccaggttttagagctagaaatagcaagttaaaataaggctagtccgttatcaacttgaaaaagtggcaccgagtcggtgc

SEQ ID NO: 1001 - DNA, 23 bp, Artificial Sequence
  Description of Artificial Sequence: Synthetic oligonucleotide
cagctacctggagccgctggagg

SEQ ID NO: 1002 - DNA, 119 bp, Artificial Sequence
  Description of Artificial Sequence: Synthetic polynucleotide
attctaatacgactcactataggcagctacctggagccgctgggttttagagctagaaatagcaagttaaaataaggctagtccgttatcaacttgaaaaagtggcaccgagtcggtgc

SEQ ID NO: 1003 - DNA, 23 bp, Artificial Sequence
  Description of Artificial Sequence: Synthetic oligonucleotide
ctacctggagccgctggaggagg

SEQ ID NO: 1004 - DNA, 119 bp, Artificial Sequence
  Description of Artificial Sequence: Synthetic polynucleotide
attctaatacgactcactataggctacctggagccgctggagggttttagagctagaaatagcaagttaaaataaggctagtccgttatcaacttgaaaaagtggcaccgagtcggtgc

SEQ ID NO: 1005 - DNA, 23 bp, Artificial Sequence
  Description of Artificial Sequence: Synthetic oligonucleotide
tacctggagccgctggaggaggg

SEQ ID NO: 1006 - DNA, 119 bp, Artificial Sequence
  Description of Artificial Sequence: Synthetic polynucleotide
attctaatacgactcactataggtacctggagccgctggaggagttttagagctagaaatagcaagttaaaataaggctagtccgttatcaacttgaaaaagtggcaccgagtcggtgc

SEQ ID NO: 1007 - DNA, 23 bp, Artificial Sequence
  Description of Artificial Sequence: Synthetic oligonucleotide
acgaaatctccctccaaaagtgg

SEQ ID NO: 1008 - DNA, 119 bp, Artificial Sequence
  Description of Artificial Sequence: Synthetic polynucleotide
attctaatacgactcactataggacgaaatctccctccaaaaggttttagagctagaaatagcaagttaaaataaggctagtccgttatcaacttgaaaaagtggcaccgagtcggtgc

SEQ ID NO: 1009 - DNA, 23 bp, Artificial Sequence
  Description of Artificial Sequence: Synthetic oligonucleotide
tgcatcctttccctgaaatcagg

SEQ ID NO: 1010 - DNA, 119 bp, Artificial Sequence
  Description of Artificial Sequence: Synthetic polynucleotide
attctaatacgactcactataggtgcatcctttccctgaaatcgttttagagctagaaatagcaagttaaaataaggctagtccgttatcaacttgaaaaagtggcaccgagtcggtgc

SEQ ID NO: 1011 - DNA, 23 bp, Artificial Sequence
  Description of Artificial Sequence: Synthetic oligonucleotide
ttgttgctggctggcaggctagg

SEQ ID NO: 1012 - DNA, 119 bp, Artificial Sequence
  Description of Artificial Sequence: Synthetic polynucleotide
attctaatacgactcactataggttgttgctggctggcaggctgttttagagctagaaatagcaagttaaaataaggctagtccgttatcaacttgaaaaagtggcaccgagtcggtgc

SEQ ID NO: 1013 - DNA, 21 bp, Homo sapiens
agcccagccccagcctgccag

SEQ ID NO: 1014 - DNA, 21 bp, Artificial Sequence
  Description of Artificial Sequence: Synthetic oligonucleotide
agcccagccctagcctgccag

SEQ ID NO: 1015 - DNA, 23 bp, Artificial Sequence
  Description of Artificial Sequence: Synthetic oligonucleotide
gctggctggcaggctagggctgg

SEQ ID NO: 1016 - DNA, 119 bp, Artificial Sequence
  Description of Artificial Sequence: Synthetic polynucleotide
attctaatacgactcactatagggctggctggcaggctagggcgttttagagctagaaatagcaagttaaaataaggctagtccgttatcaacttgaaaaagtggcaccgagtcggtgc

SEQ ID NO: 1017 - DNA, 23 bp, Artificial Sequence
  Description of Artificial Sequence: Synthetic oligonucleotide
ctggcaggctagggctgggctgg

SEQ ID NO: 1018 - DNA, 119 bp, Artificial Sequence
  Description of Artificial Sequence: Synthetic polynucleotide
attctaatacgactcactataggctggcaggctagggctgggcgttttagagctagaaatagcaagttaaaataaggctagtccgttatcaacttgaaaaagtggcaccgagtcggtgc

SEQ ID NO: 1019 - DNA, 23 bp, Artificial Sequence
  Description of Artificial Sequence: Synthetic oligonucleotide
tgttgctggctggcaggctaggg

SEQ ID NO: 1020 - DNA, 119 bp, Artificial Sequence
  Description of Artificial Sequence: Synthetic polynucleotide
attctaatacgactcactataggtgttgctggctggcaggctagttttagagctagaaatagcaagttaaaataaggctagtccgttatcaacttgaaaaagtggcaccgagtcggtgc

SEQ ID NO: 1021 - DNA, 23 bp, Artificial Sequence
  Description of Artificial Sequence: Synthetic oligonucleotide
ctggctggcaggctagggctggg

SEQ ID NO: 1022 - DNA, 119 bp, Artificial Sequence
  Description of Artificial Sequence: Synthetic polynucleotide
attctaatacgactcactataggctggctggcaggctagggctgttttagagctagaaatagcaagttaaaataaggctagtccgttatcaacttgaaaaagtggcaccgagtcggtgc

SEQ ID NO: 1023 - DNA, 23 bp, Artificial Sequence
  Description of Artificial Sequence: Synthetic oligonucleotide
tggcaggctagggctgggctggg

SEQ ID NO: 1024 - DNA, 119 bp, Artificial Sequence
  Description of Artificial Sequence: Synthetic polynucleotide
attctaatacgactcactataggtggcaggctagggctgggctgttttagagctagaaatagcaagttaaaataaggctagtccgttatcaacttgaaaaagtggcaccgagtcggtgc

SEQ ID NO: 1025 - DNA, 23 bp, Artificial Sequence
  Description of Artificial Sequence: Synthetic oligonucleotide
ggcaggctagggctgggctgggg

SEQ ID NO: 1026 - DNA, 119 bp, Artificial Sequence
  Description of Artificial Sequence: Synthetic polynucleotide
attctaatacgactcactataggggcaggctagggctgggctggttttagagctagaaatagcaagttaaaataaggctagtccgttatcaacttgaaaaagtggcaccgagtcggtgc

SEQ ID NO: 1027 - DNA, 23 bp, Artificial Sequence
  Description of Artificial Sequence: Synthetic oligonucleotide
gcaggctagggctgggctggggg

SEQ ID NO: 1028 - DNA, 119 bp, Artificial Sequence
  Description of Artificial Sequence: Synthetic polynucleotide
attctaatacgactcactatagggcaggctagggctgggctgggttttagagctagaaatagcaagttaaaataaggctagtccgttatcaacttgaaaaagtggcaccgagtcggtgc

SEQ ID NO: 1029 - DNA, 23 bp, Artificial Sequence
  Description of Artificial Sequence: Synthetic oligonucleotide
actaacttatgaaaaggaagagg

SEQ ID NO: 1030 - DNA, 119 bp, Artificial Sequence
  Description of Artificial Sequence: Synthetic polynucleotide
attctaatacgactcactataggactaacttatgaaaaggaaggttttagagctagaaatagcaagttaaaataaggctagtccgttatcaacttgaaaaagtggcaccgagtcggtgc

SEQ ID NO: 1031 - DNA, 21 bp, Homo sapiens
atgaaaaggaggaggaacagg

SEQ ID NO: 1032 - DNA, 21 bp, Artificial Sequence
  Description of Artificial Sequence: Synthetic oligonucleotide
atgaaaaggaagaggaacagg

SEQ ID NO: 1033 - DNA, 23 bp, Artificial Sequence
  Description of Artificial Sequence: Synthetic oligonucleotide
ttatgaaaaggaagaggaacagg

SEQ ID NO: 1034 - DNA, 119 bp, Artificial Sequence
  Description of Artificial Sequence: Synthetic polynucleotide
attctaatacgactcactataggttatgaaaaggaagaggaacgttttagagctagaaatagcaagttaaaataaggctagtccgttatcaacttgaaaaagtggcaccgagtcggtgc

SEQ ID NO: 1035 - DNA, 23 bp, Artificial Sequence
  Description of Artificial Sequence: Synthetic oligonucleotide
aaggaagaggaacaggaccaagg

SEQ ID NO: 1036 - DNA, 119 bp, Artificial Sequence
  Description of Artificial Sequence: Synthetic polynucleotide
attctaatacgactcactataggaaggaagaggaacaggaccagttttagagctagaaatagcaagttaaaataaggctagtccgttatcaacttgaaaaagtggcaccgagtcggtgc

SEQ ID NO: 1037 - DNA, 23 bp, Artificial Sequence
  Description of Artificial Sequence: Synthetic oligonucleotide
aggaagaggaacaggaccaaggg

SEQ ID NO: 1038 - DNA, 119 bp, Artificial Sequence
  Description of Artificial Sequence: Synthetic polynucleotide
attctaatacgactcactataggaggaagaggaacaggaccaagttttagagctagaaatagcaagttaaaataaggctagtccgttatcaacttgaaaaagtggcaccgagtcggtgc

SEQ ID NO: 1039 - DNA, 23 bp, Artificial Sequence
  Description of Artificial Sequence: Synthetic oligonucleotide
ggaagaggaacaggaccaagggg

SEQ ID NO: 1040 - DNA, 119 bp, Artificial Sequence
  Description of Artificial Sequence: Synthetic polynucleotide
attctaatacgactcactataggggaagaggaacaggaccaaggttttagagctagaaatagcaagttaaaataaggctagtccgttatcaacttgaaaaagtggcaccgagtcggtgc

SEQ ID NO: 1041 - DNA, 23 bp, Artificial Sequence
  Description of Artificial Sequence: Synthetic oligonucleotide
tcttccttttcataagttagtgg

SEQ ID NO: 1042 - DNA, 119 bp, Artificial Sequence
  Description of Artificial Sequence: Synthetic polynucleotide
attctaatacgactcactataggtcttccttttcataagttaggttttagagctagaaatagcaagttaaaataaggctagtccgttatcaacttgaaaaagtggcaccgagtcggtgc

SEQ ID NO: 1043 - DNA, 23 bp, Artificial Sequence
  Description of Artificial Sequence: Synthetic oligonucleotide
ccaggacaacaatgtggacctgg

SEQ ID NO: 1044 - DNA, 119 bp, Artificial Sequence
  Description of Artificial Sequence: Synthetic polynucleotide
attctaatacgactcactataggccaggacaacaatgtggaccgttttagagctagaaatagcaagttaaaataaggctagtccgttatcaacttgaaaaagtggcaccgagtcggtgc

SEQ ID NO: 1045 - DNA, 26 bp, Homo sapiens
caatgtggacctgattctggccacac

SEQ ID NO: 1046 - DNA, 20 bp, Artificial Sequence
  Description of Artificial Sequence: Synthetic oligonucleotide
caatgtggacctggccacac

SEQ ID NO: 1047 - DNA, 23 bp, Artificial Sequence
  Description of Artificial Sequence: Synthetic oligonucleotide
ggctgaaggggggtgtggccagg

SEQ ID NO: 1048 - DNA, 119 bp, Artificial Sequence
  Description of Artificial Sequence: Synthetic polynucleotide
attctaatacgactcactataggggctgaaggggggtgtggccgttttagagctagaaatagcaagttaaaataaggctagtccgttatcaacttgaaaaagtggcaccgagtcggtgc

SEQ ID NO: 1049 - DNA, 23 bp, Artificial Sequence
  Description of Artificial Sequence: Synthetic oligonucleotide
ccaggtccacattgttgtcctgg

SEQ ID NO: 1050 - DNA, 119 bp, Artificial Sequence
  Description of Artificial Sequence: Synthetic polynucleotide
attctaatacgactcactataggccaggtccacattgttgtccgttttagagctagaaatagcaagttaaaataaggctagtccgttatcaacttgaaaaagtggcaccgagtcggtgc

SEQ ID NO: 1051 - DNA, 23 bp, Artificial Sequence
  Description of Artificial Sequence: Synthetic oligonucleotide
ggaggaaaagatgtatgtccagg

SEQ ID NO: 1052 - DNA, 119 bp, Artificial Sequence
  Description of Artificial Sequence: Synthetic polynucleotide
attctaatacgactcactataggggaggaaaagatgtatgtccgttttagagctagaaatagcaagttaaaataaggctagtccgttatcaacttgaaaaagtggcaccgagtcggtgc

SEQ ID NO: 1053 - DNA, 21 bp, Homo sapiens
aaagatgtatatccagggcag

SEQ ID NO: 1054 - DNA, 21 bp, Artificial Sequence
  Description of Artificial Sequence: Synthetic oligonucleotide
aaagatgtatgtccagggcag

SEQ ID NO: 1055 - DNA, 23 bp, Artificial Sequence
  Description of Artificial Sequence: Synthetic oligonucleotide
tatgtccagggcagtgtctttgg

SEQ ID NO: 1056 - DNA, 119 bp, Artificial Sequence
  Description of Artificial Sequence: Synthetic polynucleotide
attctaatacgactcactataggtatgtccagggcagtgtcttgttttagagctagaaatagcaagttaaaataaggctagtccgttatcaacttgaaaaagtggcaccgagtcggtgc

SEQ ID NO: 1057 - DNA, 23 bp, Artificial Sequence
  Description of Artificial Sequence: Synthetic oligonucleotide
gaggaaaagatgtatgtccaggg

SEQ ID NO: 1058 - DNA, 119 bp, Artificial Sequence
  Description of Artificial Sequence: Synthetic polynucleotide
attctaatacgactcactatagggaggaaaagatgtatgtccagttttagagctagaaatagcaagttaaaataaggctagtccgttatcaacttgaaaaagtggcaccgagtcggtgc

SEQ ID NO: 1059 - DNA, 23 bp, Artificial Sequence
  Description of Artificial Sequence: Synthetic oligonucleotide
atgtccagggcagtgtctttggg

SEQ ID NO: 1060 - DNA, 119 bp, Artificial Sequence
  Description of Artificial Sequence: Synthetic polynucleotide
attctaatacgactcactataggatgtccagggcagtgtctttgttttagagctagaaatagcaagttaaaataaggctagtccgttatcaacttgaaaaagtggcaccgagtcggtgc

SEQ ID NO: 1061 - DNA, 23 bp, Artificial Sequence
  Description of Artificial Sequence: Synthetic oligonucleotide
gcacaaactccatgtctggtagg

SEQ ID NO: 1062 - DNA, 119 bp, Artificial Sequence
  Description of Artificial Sequence: Synthetic polynucleotide
attctaatacgactcactatagggcacaaactccatgtctggtgttttagagctagaaatagcaagttaaaataaggctagtccgttatcaacttgaaaaagtggcaccgagtcggtgc

SEQ ID NO: 1063 - DNA, 21 bp, Homo sapiens
catgtctggtggggtacagac

SEQ ID NO: 1064 - DNA, 21 bp, Artificial Sequence
  Description of Artificial Sequence: Synthetic oligonucleotide
catgtctggtagggtacagac

SEQ ID NO: 1065 - DNA, 23 bp, Artificial Sequence
  Description of Artificial Sequence: Synthetic oligonucleotide
ctggtagggtacagactccaagg

SEQ ID NO: 1066 - DNA, 119 bp, Artificial Sequence
  Description of Artificial Sequence: Synthetic polynucleotide
attctaatacgactcactataggctggtagggtacagactccagttttagagctagaaatagcaagttaaaataaggctagtccgttatcaacttgaaaaagtggcaccgagtcggtgc

SEQ ID NO: 1067 - DNA, 23 bp, Artificial Sequence
  Description of Artificial Sequence: Synthetic oligonucleotide
cacaaactccatgtctggtaggg

SEQ ID NO: 1068 - DNA, 119 bp, Artificial Sequence
  Description of Artificial Sequence: Synthetic polynucleotide
attctaatacgactcactataggcacaaactccatgtctggtagttttagagctagaaatagcaagttaaaataaggctagtccgttatcaacttgaaaaagtggcaccgagtcggtgc

SEQ ID NO: 1069 - DNA, 23 bp, Artificial Sequence
  Description of Artificial Sequence: Synthetic oligonucleotide
tggtagggtacagactccaaggg

SEQ ID NO: 1070 - DNA, 119 bp, Artificial Sequence
  Description of Artificial Sequence: Synthetic polynucleotide
attctaatacgactcactataggtggtagggtacagactccaagttttagagctagaaatagcaagttaaaataaggctagtccgttatcaacttgaaaaagtggcaccgagtcggtgc

SEQ ID NO: 1071 - DNA, 23 bp, Artificial Sequence
  Description of Artificial Sequence: Synthetic oligonucleotide
agtctgtaccctaccagacatgg

SEQ ID NO: 1072 - DNA, 119 bp, Artificial Sequence
  Description of Artificial Sequence: Synthetic polynucleotide
attctaatacgactcactataggagtctgtaccctaccagacagttttagagctagaaatagcaagttaaaataaggctagtccgttatcaacttgaaaaagtggcaccgagtcggtgc

SEQ ID NO: 1073 - DNA, 23 bp, Artificial Sequence
  Description of Artificial Sequence: Synthetic oligonucleotide
gtgttgacaataatggacccagg

SEQ ID NO: 1074 - DNA, 119 bp, Artificial Sequence
  Description of Artificial Sequence: Synthetic polynucleotide
attctaatacgactcactatagggtgttgacaataatggacccgttttagagctagaaatagcaagttaaaataaggctagtccgttatcaacttgaaaaagtggcaccgagtcggtgc

SEQ ID NO: 1075 - DNA, 23 bp, Artificial Sequence
  Description of Artificial Sequence: Synthetic oligonucleotide
gaggttggtgttgacaataatgg

SEQ ID NO: 1076 - DNA, 119 bp, Artificial Sequence
  Description of Artificial Sequence: Synthetic polynucleotide
attctaatacgactcactatagggaggttggtgttgacaataagttttagagctagaaatagcaagttaaaataaggctagtccgttatcaacttgaaaaagtggcaccgagtcggtgc

SEQ ID NO: 1077 - DNA, 23 bp, Artificial Sequence
  Description of Artificial Sequence: Synthetic oligonucleotide
aaagtcccgcccattcgggtagg

SEQ ID NO: 1078 - DNA, 119 bp, Artificial Sequence
  Description of Artificial Sequence: Synthetic polynucleotide
attctaatacgactcactataggaaagtcccgcccattcgggtgttttagagctagaaatagcaagttaaaataaggctagtccgttatcaacttgaaaaagtggcaccgagtcggtgc

SEQ ID NO: 1079 - DNA, 21 bp, Homo sapiens
tcccgcccatccgggtaggag

SEQ ID NO: 1080 - DNA, 21 bp, Artificial Sequence
  Description of Artificial Sequence: Synthetic oligonucleotide
tcccgcccattcgggtaggag

SEQ ID NO: 1081 - DNA, 23 bp, Artificial Sequence
  Description of Artificial Sequence: Synthetic oligonucleotide
agcccaaagtcccgcccattcgg

SEQ ID NO: 1082 - DNA, 119 bp, Artificial Sequence
  Description of Artificial Sequence: Synthetic polynucleotide
attctaatacgactcactataggagcccaaagtcccgcccattgttttagagctagaaatagcaagttaaaataaggctagtccgttatcaacttgaaaaagtggcaccgagtcggtgc

SEQ ID NO: 1083 - DNA, 23 bp, Artificial Sequence
  Description of Artificial Sequence: Synthetic oligonucleotide
gcccaaagtcccgcccattcggg

SEQ ID NO: 1084 - DNA, 119 bp, Artificial Sequence
  Description of Artificial Sequence: Synthetic polynucleotide
attctaatacgactcactatagggcccaaagtcccgcccattcgttttagagctagaaatagcaagttaaaataaggctagtccgttatcaacttgaaaaagtggcaccgagtcggtgc

SEQ ID NO: 1085 - DNA, 23 bp, Artificial Sequence
  Description of Artificial Sequence: Synthetic oligonucleotide
caaacagtctcctacccgaatgg

SEQ ID NO: 1086 - DNA, 119 bp, Artificial Sequence
  Description of Artificial Sequence: Synthetic polynucleotide
attctaatacgactcactataggcaaacagtctcctacccgaagttttagagctagaaatagcaagttaaaataaggctagtccgttatcaacttgaaaaagtggcaccgagtcggtgc

SEQ ID NO: 1087 - DNA, 23 bp, Artificial Sequence
  Description of Artificial Sequence: Synthetic oligonucleotide
tacccgaatgggcgggactttgg

SEQ ID NO: 1088 - DNA, 119 bp, Artificial Sequence
  Description of Artificial Sequence: Synthetic polynucleotide
attctaatacgactcactataggtacccgaatgggcgggacttgttttagagctagaaatagcaagttaaaataaggctagtccgttatcaacttgaaaaagtggcaccgagtcggtgc

SEQ ID NO: 1089 - DNA, 23 bp, Artificial Sequence
  Description of Artificial Sequence: Synthetic oligonucleotide
cagtctcctacccgaatgggcgg

SEQ ID NO: 1090 - DNA, 119 bp, Artificial Sequence
  Description of Artificial Sequence: Synthetic polynucleotide
attctaatacgactcactataggcagtctcctacccgaatggggttttagagctagaaatagcaagttaaaataaggctagtccgttatcaacttgaaaaagtggcaccgagtcggtgc

SEQ ID NO: 1091 - DNA, 23 bp, Artificial Sequence
  Description of Artificial Sequence: Synthetic oligonucleotide
aaacagtctcctacccgaatggg

SEQ ID NO: 1092 - DNA, 119 bp, Artificial Sequence
  Description of Artificial Sequence: Synthetic polynucleotide
attctaatacgactcactataggaaacagtctcctacccgaatgttttagagctagaaatagcaagttaaaataaggctagtccgttatcaacttgaaaaagtggcaccgagtcggtgc

SEQ ID NO: 1093 - DNA, 23 bp, Artificial Sequence
  Description of Artificial Sequence: Synthetic oligonucleotide
agtctcctacccgaatgggcggg

SEQ ID NO: 1094 - DNA, 119 bp, Artificial Sequence
  Description of Artificial Sequence: Synthetic polynucleotide
attctaatacgactcactataggagtctcctacccgaatgggcgttttagagctagaaatagcaagttaaaataaggctagtccgttatcaacttgaaaaagtggcaccgagtcggtgc

SEQ ID NO: 1095 - DNA, 23 bp, Artificial Sequence
  Description of Artificial Sequence: Synthetic oligonucleotide
acccgaatgggcgggactttggg

SEQ ID NO: 1096 - DNA, 119 bp, Artificial Sequence
  Description of Artificial Sequence: Synthetic polynucleotide
attctaatacgactcactataggacccgaatgggcgggactttgttttagagctagaaatagcaagttaaaataaggctagtccgttatcaacttgaaaaagtggcaccgagtcggtgc

SEQ ID NO: 1097 - DNA, 23 bp, Artificial Sequence
  Description of Artificial Sequence: Synthetic oligonucleotide
aaagtcccgcccatctgggtagg

SEQ ID NO: 1098 - DNA, 119 bp, Artificial Sequence
  Description of Artificial Sequence: Synthetic polynucleotide
attctaatacgactcactataggaaagtcccgcccatctgggtgttttagagctagaaatagcaagttaaaataaggctagtccgttatcaacttgaaaaagtggcaccgagtcggtgc

SEQ ID NO: 1099 - DNA, 21 bp, Homo sapiens
cccgcccatccgggtaggaga

SEQ ID NO: 1100 - DNA, 21 bp, Artificial Sequence
  Description of Artificial Sequence: Synthetic oligonucleotide
cccgcccatctgggtaggaga

SEQ ID NO: 1101 - DNA, 23 bp, Artificial Sequence
  Description of Artificial Sequence: Synthetic oligonucleotide
agcccaaagtcccgcccatctgg

SEQ ID NO: 1102 - DNA, 119 bp, Artificial Sequence
  Description of Artificial Sequence: Synthetic polynucleotide
attctaatacgactcactataggagcccaaagtcccgcccatcgttttagagctagaaatagcaagttaaaataaggctagtccgttatcaacttgaaaaagtggcaccgagtcggtgc

SEQ ID NO: 1103 - DNA, 23 bp, Artificial Sequence
  Description of Artificial Sequence: Synthetic oligonucleotide
gcccaaagtcccgcccatctggg

SEQ ID NO: 1104 - DNA, 119 bp, Artificial Sequence
  Description of Artificial Sequence: Synthetic polynucleotide
attctaatacgactcactatagggcccaaagtcccgcccatctgttttagagctagaaatagcaagttaaaataaggctagtccgttatcaacttgaaaaagtggcaccgagtcggtgc

SEQ ID NO: 1105 - DNA, 23 bp, Artificial Sequence
  Description of Artificial Sequence: Synthetic oligonucleotide
caaacagtctcctacccagatgg

SEQ ID NO: 1106 - DNA, 119 bp, Artificial Sequence
  Description of Artificial Sequence: Synthetic polynucleotide
attctaatacgactcactataggcaaacagtctcctacccagagttttagagctagaaatagcaagttaaaataaggctagtccgttatcaacttgaaaaagtggcaccgagtcggtgc

SEQ ID NO: 1107 - DNA, 23 bp, Artificial Sequence
  Description of Artificial Sequence: Synthetic oligonucleotide
tacccagatgggcgggactttgg

SEQ ID NO: 1108 - DNA, 119 bp, Artificial Sequence
  Description of Artificial Sequence: Synthetic polynucleotide
attctaatacgactcactataggtacccagatgggcgggacttgttttagagctagaaatagcaagttaaaataaggctagtccgttatcaacttgaaaaagtggcaccgagtcggtgc

SEQ ID NO: 1109 - DNA, 23 bp, Artificial Sequence
  Description of Artificial Sequence: Synthetic oligonucleotide
cagtctcctacccagatgggcgg

SEQ ID NO: 1110 - DNA, 119 bp, Artificial Sequence
  Description of Artificial Sequence: Synthetic polynucleotide
attctaatacgactcactataggcagtctcctacccagatggggttttagagctagaaatagcaagttaaaataaggctagtccgttatcaacttgaaaaagtggcaccgagtcggtgc

SEQ ID NO: 1111 - DNA, 23 bp, Artificial Sequence
  Description of Artificial Sequence: Synthetic oligonucleotide
aaacagtctcctacccagatggg

SEQ ID NO: 1112 - DNA, 119 bp, Artificial Sequence
  Description of Artificial Sequence: Synthetic polynucleotide
attctaatacgactcactataggaaacagtctcctacccagatgttttagagctagaaatagcaagttaaaataaggctagtccgttatcaacttgaaaaagtggcaccgagtcggtgc

SEQ ID NO: 1113 - DNA, 23 bp, Artificial Sequence
  Description of Artificial Sequence: Synthetic oligonucleotide
agtctcctacccagatgggcggg

SEQ ID NO: 1114 - DNA, 119 bp, Artificial Sequence
  Description of Artificial Sequence: Synthetic polynucleotide
attctaatacgactcactataggagtctcctacccagatgggcgttttagagctagaaatagcaagttaaaataaggctagtccgttatcaacttgaaaaagtggcaccgagtcggtgc

SEQ ID NO: 1115 - DNA, 23 bp, Artificial Sequence
  Description of Artificial Sequence: Synthetic oligonucleotide
acccagatgggcgggactttggg

SEQ ID NO: 1116 - DNA, 119 bp, Artificial Sequence
  Description of Artificial Sequence: Synthetic polynucleotide
attctaatacgactcactataggacccagatgggcgggactttgttttagagctagaaatagcaagttaaaataaggctagtccgttatcaacttgaaaaagtggcaccgagtcggtgc

SEQ ID NO: 1117 - DNA, 23 bp, Artificial Sequence
  Description of Artificial Sequence: Synthetic oligonucleotide
aaagtcccgcccatttgggtagg

SEQ ID NO: 1118 - DNA, 119 bp, Artificial Sequence
  Description of Artificial Sequence: Synthetic polynucleotide
attctaatacgactcactataggaaagtcccgcccatttgggtgttttagagctagaaatagcaagttaaaataaggctagtccgttatcaacttgaaaaagtggcaccgagtcggtgc

SEQ ID NO: 1119 - DNA, 23 bp, Artificial Sequence
  Description of Artificial Sequence: Synthetic oligonucleotide
agcccaaagtcccgcccatttgg

SEQ ID NO: 1120 - DNA, 23 bp, Artificial Sequence
  Description of Artificial Sequence: Synthetic oligonucleotide
gcccaaagtcccgcccatttggg

SEQ ID NO: 1121 - DNA, 119 bp, Artificial Sequence
  Description of Artificial Sequence: Synthetic polynucleotide
attctaatacgactcactatagggcccaaagtcccgcccatttgttttagagctagaaatagcaagttaaaataaggctagtccgttatcaacttgaaaaagtggcaccgagtcggtgc

SEQ ID NO: 1122 - DNA, 23 bp, Artificial Sequence
  Description of Artificial Sequence: Synthetic oligonucleotide
caaacagtctcctacccaaatgg

SEQ ID NO: 1123 - DNA, 119 bp, Artificial Sequence
  Description of Artificial Sequence: Synthetic polynucleotide
attctaatacgactcactataggcaaacagtctcctacccaaagttttagagctagaaatagcaagttaaaataaggctagtccgttatcaacttgaaaaagtggcaccgagtcggtgc

SEQ ID NO: 1124 - DNA, 23 bp, Artificial Sequence
  Description of Artificial Sequence: Synthetic oligonucleotide
tacccaaatgggcgggactttgg

SEQ ID NO: 1125 - DNA, 119 bp, Artificial Sequence
  Description of Artificial Sequence: Synthetic polynucleotide
attctaatacgactcactataggtacccaaatgggcgggacttgttttagagctagaaatagcaagttaaaataaggctagtccgttatcaacttgaaaaagtggcaccgagtcggtgc

SEQ ID NO: 1126 - DNA, 23 bp, Artificial Sequence
  Description of Artificial Sequence: Synthetic oligonucleotide
cagtctcctacccaaatgggcgg

SEQ ID NO: 1127 - DNA, 119 bp, Artificial Sequence
  Description of Artificial Sequence: Synthetic polynucleotide
attctaatacgactcactataggcagtctcctacccaaatggggttttagagctagaaatagcaagttaaaataaggctagtccgttatcaacttgaaaaagtggcaccgagtcggtgc

SEQ ID NO: 1128 - DNA, 23 bp, Artificial Sequence
  Description of Artificial Sequence: Synthetic oligonucleotide
aaacagtctcctacccaaatggg

SEQ ID NO: 1129 - DNA, 119 bp, Artificial Sequence
  Description of Artificial Sequence: Synthetic polynucleotide
attctaatacgactcactataggaaacagtctcctacccaaatgttttagagctagaaatagcaagttaaaataaggctagtccgttatcaacttgaaaaagtggcaccgagtcggtgc

SEQ ID NO: 1130 - DNA, 23 bp, Artificial Sequence
  Description of Artificial Sequence: Synthetic oligonucleotide
agtctcctacccaaatgggcggg

SEQ ID NO: 1131 - DNA, 119 bp, Artificial Sequence
  Description of Artificial Sequence: Synthetic polynucleotide
attctaatacgactcactataggagtctcctacccaaatgggcgttttagagctagaaatagcaagttaaaataaggctagtccgttatcaacttgaaaaagtggcaccgagtcggtgc

SEQ ID NO: 1132 - DNA, 23 bp, Artificial Sequence
  Description of Artificial Sequence: Synthetic oligonucleotide
acccaaatgggcgggactttggg

SEQ ID NO: 1133 - DNA, 119 bp, Artificial Sequence
  Description of Artificial Sequence: Synthetic polynucleotide
attctaatacgactcactataggacccaaatgggcgggactttgttttagagctagaaatagcaagttaaaataaggctagtccgttatcaacttgaaaaagtggcaccgagtcggtgc

SEQ ID NO: 1134 - DNA, 23 bp, Artificial Sequence
  Description of Artificial Sequence: Synthetic oligonucleotide
taaagcagctgagtcactaaagg

SEQ ID NO: 1135 - DNA, 119 bp, Artificial Sequence
  Description of Artificial Sequence: Synthetic polynucleotide
attctaatacgactcactataggtaaagcagctgagtcactaagttttagagctagaaatagcaagttaaaataaggctagtccgttatcaacttgaaaaagtggcaccgagtcggtgc

SEQ ID NO: 1136 - DNA, 23 bp, Artificial Sequence
  Description of Artificial Sequence: Synthetic oligonucleotide
ttagtgactcagctgctttaagg

SEQ ID NO: 1137 - DNA, 119 bp, Artificial Sequence
  Description of Artificial Sequence: Synthetic polynucleotide
attctaatacgactcactataggttagtgactcagctgctttagttttagagctagaaatagcaagttaaaataaggctagtccgttatcaacttgaaaaagtggcaccgagtcggtgc

SEQ ID NO: 1138 - DNA, 23 bp, Artificial Sequence
  Description of Artificial Sequence: Synthetic oligonucleotide
ttaaggcaaagatgttcccatgg

SEQ ID NO: 1139 - DNA, 119 bp, Artificial Sequence
  Description of Artificial Sequence: Synthetic polynucleotide
attctaatacgactcactataggttaaggcaaagatgttcccagttttagagctagaaatagcaagttaaaataaggctagtccgttatcaacttgaaaaagtggcaccgagtcggtgc

SEQ ID NO: 1140 - DNA, 23 bp, Artificial Sequence
  Description of Artificial Sequence: Synthetic oligonucleotide
ttctttctgtgagaaagtactgg

SEQ ID NO: 1141 - DNA, 119 bp, Artificial Sequence
  Description of Artificial Sequence: Synthetic polynucleotide
attctaatacgactcactataggttctttctgtgagaaagtacgttttagagctagaaatagcaagttaaaataaggctagtccgttatcaacttgaaaaagtggcaccgagtcggtgc

SEQ ID NO: 1142 - DNA, 23 bp, Artificial Sequence
  Description of Artificial Sequence: Synthetic oligonucleotide
gtatgttgtttttaattttaagg

SEQ ID NO: 1143 - DNA, 119 bp, Artificial Sequence
  Description of Artificial Sequence: Synthetic polynucleotide
attctaatacgactcactatagggtatgttgtttttaattttagttttagagctagaaatagcaagttaaaataaggctagtccgttatcaacttgaaaaagtggcaccgagtcggtgc

SEQ ID NO: 1144 - DNA, 23 bp, Artificial Sequence
  Description of Artificial Sequence: Synthetic oligonucleotide
tttaattttaaggccgcaaaagg

SEQ ID NO: 1145 - DNA, 119 bp, Artificial Sequence
  Description of Artificial Sequence: Synthetic polynucleotide
attctaatacgactcactataggtttaattttaaggccgcaaagttttagagctagaaatagcaagttaaaataaggctagtccgttatcaacttgaaaaagtggcaccgagtcggtgc

SEQ ID NO: 1146 - DNA, 23 bp, Artificial Sequence
  Description of Artificial Sequence: Synthetic oligonucleotide
taaggccgcaaaaggagatttgg

SEQ ID NO: 1147 - DNA, 119 bp, Artificial Sequence
  Description of Artificial Sequence: Synthetic polynucleotide
attctaatacgactcactataggtaaggccgcaaaaggagattgttttagagctagaaatagcaagttaaaataaggctagtccgttatcaacttgaaaaagtggcaccgagtcggtgc

SEQ ID NO: 1148 - DNA, 23 bp, Artificial Sequence
  Description of Artificial Sequence: Synthetic oligonucleotide
gcctgggcaggaaaaattctcgg

SEQ ID NO: 1149 - DNA, 119 bp, Artificial Sequence
  Description of Artificial Sequence: Synthetic polynucleotide
attctaatacgactcactatagggcctgggcaggaaaaattctgttttagagctagaaatagcaagttaaaataaggctagtccgttatcaacttgaaaaagtggcaccgagtcggtgc

SEQ ID NO: 1150 - DNA, 23 bp, Artificial Sequence
  Description of Artificial Sequence: Synthetic oligonucleotide
tccgagaatttttcctgcccagg

SEQ ID NO: 1151 - DNA, 119 bp, Artificial Sequence
  Description of Artificial Sequence: Synthetic polynucleotide
attctaatacgactcactataggtccgagaatttttcctgcccgttttagagctagaaatagcaagttaaaataaggctagtccgttatcaacttgaaaaagtggcaccgagtcggtgc

SEQ ID NO: 1152 - DNA, 23 bp, Artificial Sequence
  Description of Artificial Sequence: Synthetic oligonucleotide
ctagtagcatacctcgaccatgg

SEQ ID NO: 1153 - DNA, 119 bp, Artificial Sequence
  Description of Artificial Sequence: Synthetic polynucleotide
attctaatacgactcactataggctagtagcatacctcgaccagttttagagctagaaatagcaagttaaaataaggctagtccgttatcaacttgaaaaagtggcaccgagtcggtgc

SEQ ID NO: 1154 - DNA, 21 bp, Homo sapiens
tagtagcatagctcgaccatg

SEQ ID NO: 1155 - DNA, 21 bp, Artificial Sequence
  Description of Artificial Sequence: Synthetic oligonucleotide
tagtagcatacctcgaccatg

SEQ ID NO: 1156 - DNA, 23 bp, Artificial Sequence
  Description of Artificial Sequence: Synthetic oligonucleotide
tggtcgaggtatgctactagtgg

SEQ ID NO: 1157 - DNA, 119 bp, Artificial Sequence
  Description of Artificial Sequence: Synthetic polynucleotide
attctaatacgactcactataggtggtcgaggtatgctactaggttttagagctagaaatagcaagttaaaataaggctagtccgttatcaacttgaaaaagtggcaccgagtcggtgc

SEQ ID NO: 1158 - DNA, 23 bp, Artificial Sequence
  Description of Artificial Sequence: Synthetic oligonucleotide
ggtcgaggtatgctactagtggg

SEQ ID NO: 1159 - DNA, 119 bp, Artificial Sequence
  Description of Artificial Sequence: Synthetic polynucleotide
attctaatacgactcactataggggtcgaggtatgctactagtgttttagagctagaaatagcaagttaaaataaggctagtccgttatcaacttgaaaaagtggcaccgagtcggtgc

SEQ ID NO: 1160 - DNA, 23 bp, Artificial Sequence
  Description of Artificial Sequence: Synthetic oligonucleotide
ctttccaattgcactgactccgg

SEQ ID NO: 1161 - DNA, 119 bp, Artificial Sequence
  Description of Artificial Sequence: Synthetic polynucleotide
attctaatacgactcactataggctttccaattgcactgactcgttttagagctagaaatagcaagttaaaataaggctagtccgttatcaacttgaaaaagtggcaccgagtcggtgc

SEQ ID NO: 1162 - DNA, 23 bp, Artificial Sequence
  Description of Artificial Sequence: Synthetic oligonucleotide
cggagtcagtgcaattggaaagg

SEQ ID NO: 1163 - DNA, 119 bp, Artificial Sequence
  Description of Artificial Sequence: Synthetic polynucleotide
attctaatacgactcactataggcggagtcagtgcaattggaagttttagagctagaaatagcaagttaaaataaggctagtccgttatcaacttgaaaaagtggcaccgagtcggtgc

SEQ ID NO: 1164 - DNA, 23 bp, Artificial Sequence
  Description of Artificial Sequence: Synthetic oligonucleotide
gtggccggagtcagtgcaattgg

SEQ ID NO: 1165 - DNA, 119 bp, Artificial Sequence
  Description of Artificial Sequence: Synthetic polynucleotide
attctaatacgactcactatagggtggccggagtcagtgcaatgttttagagctagaaatagcaagttaaaataaggctagtccgttatcaacttgaaaaagtggcaccgagtcggtgc

SEQ ID NO: 1166 - DNA, 23 bp, Artificial Sequence
  Description of Artificial Sequence: Synthetic oligonucleotide
ctacttaacatctgaaaatctgg

SEQ ID NO: 1167 - DNA, 119 bp, Artificial Sequence
  Description of Artificial Sequence: Synthetic polynucleotide
attctaatacgactcactataggctacttaacatctgaaaatcgttttagagctagaaatagcaagttaaaataaggctagtccgttatcaacttgaaaaagtggcaccgagtcggtgc

SEQ ID NO: 1168 - DNA, 23 bp, Artificial Sequence
  Description of Artificial Sequence: Synthetic oligonucleotide
tacttaacatctgaaaatctggg

SEQ ID NO: 1169 - DNA, 119 bp, Artificial Sequence
  Description of Artificial Sequence: Synthetic polynucleotide
attctaatacgactcactataggtacttaacatctgaaaatctgttttagagctagaaatagcaagttaaaataaggctagtccgttatcaacttgaaaaagtggcaccgagtcggtgc

SEQ ID NO: 1170 - DNA, 23 bp, Artificial Sequence
  Description of Artificial Sequence: Synthetic oligonucleotide
gaaaaaaatagtagctcaagtgg

SEQ ID NO: 1171 - DNA, 119 bp, Artificial Sequence
  Description of Artificial Sequence: Synthetic polynucleotide
attctaatacgactcactatagggaaaaaaatagtagctcaaggttttagagctagaaatagcaagttaaaataaggctagtccgttatcaacttgaaaaagtggcaccgagtcggtgc

SEQ ID NO: 1172 - DNA, 23 bp, Artificial Sequence
  Description of Artificial Sequence: Synthetic oligonucleotide
aatagtagctcaagtggaagtgg

SEQ ID NO: 1173 - DNA, 119 bp, Artificial Sequence
  Description of Artificial Sequence: Synthetic polynucleotide
attctaatacgactcactataggaatagtagctcaagtggaaggttttagagctagaaatagcaagttaaaataaggctagtccgttatcaacttgaaaaagtggcaccgagtcggtgc

SEQ ID NO: 1174 - DNA, 23 bp, Artificial Sequence
  Description of Artificial Sequence: Synthetic oligonucleotide
tcctacctgctttgccggccagg

SEQ ID NO: 1175 - DNA, 119 bp, Artificial Sequence
  Description of Artificial Sequence: Synthetic polynucleotide
attctaatacgactcactataggtcctacctgctttgccggccgttttagagctagaaatagcaagttaaaataaggctagtccgttatcaacttgaaaaagtggcaccgagtcggtgc

SEQ ID NO: 1176 - DNA, 21 bp, Homo sapiens
gtcacttccttcctgctttgc

SEQ ID NO: 1177 - DNA, 21 bp, Artificial Sequence
  Description of Artificial Sequence: Synthetic oligonucleotide
gtcacttcctacctgctttgc

SEQ ID NO: 1178 - DNA, 23 bp, Artificial Sequence
  Description of Artificial Sequence: Synthetic oligonucleotide
tcacttcctacctgctttgccgg

SEQ ID NO: 1179 - DNA, 119 bp, Artificial Sequence
  Description of Artificial Sequence: Synthetic polynucleotide
attctaatacgactcactataggtcacttcctacctgctttgcgttttagagctagaaatagcaagttaaaataaggctagtccgttatcaacttgaaaaagtggcaccgagtcggtgc

SEQ ID NO: 1180 - DNA, 23 bp, Artificial Sequence
  Description of Artificial Sequence: Synthetic oligonucleotide
acctggccggcaaagcaggtagg

SEQ ID NO: 1181 - DNA, 119 bp, Artificial Sequence
  Description of Artificial Sequence: Synthetic polynucleotide
attctaatacgactcactataggacctggccggcaaagcaggtgttttagagctagaaatagcaagttaaaataaggctagtccgttatcaacttgaaaaagtggcaccgagtcggtgc

SEQ ID NO: 1182 - DNA, 23 bp, Artificial Sequence
  Description of Artificial Sequence: Synthetic oligonucleotide
aagcaggtaggaagtgacccagg

SEQ ID NO: 1183 - DNA, 119 bp, Artificial Sequence
  Description of Artificial Sequence: Synthetic polynucleotide
attctaatacgactcactataggaagcaggtaggaagtgacccgttttagagctagaaatagcaagttaaaataaggctagtccgttatcaacttgaaaaagtggcaccgagtcggtgc

SEQ ID NO: 1184 - DNA, 23 bp, Artificial Sequence
  Description of Artificial Sequence: Synthetic oligonucleotide
agacaggattgtctgccaccagg

SEQ ID NO: 1185 - DNA, 119 bp, Artificial Sequence
  Description of Artificial Sequence: Synthetic polynucleotide
attctaatacgactcactataggagacaggattgtctgccaccgttttagagctagaaatagcaagttaaaataaggctagtccgttatcaacttgaaaaagtggcaccgagtcggtgc

SEQ ID NO: 1186 - DNA, 21 bp, Homo sapiens
agacaggattctctgccacca

SEQ ID NO: 1187 - DNA, 21 bp, Artificial Sequence
  Description of Artificial Sequence: Synthetic oligonucleotide
agacaggattgtctgccacca

SEQ ID NO: 1188 - DNA, 23 bp, Artificial Sequence
  Description of Artificial Sequence: Synthetic oligonucleotide
cagacaatcctgtctttcctagg

SEQ ID NO: 1189 - DNA, 119 bp, Artificial Sequence
  Description of Artificial Sequence: Synthetic polynucleotide
attctaatacgactcactataggcagacaatcctgtctttcctgttttagagctagaaatagcaagttaaaataaggctagtccgttatcaacttgaaaaagtggcaccgagtcggtgc

SEQ ID NO: 1190 - DNA, 23 bp, Artificial Sequence
  Description of Artificial Sequence: Synthetic oligonucleotide
caatcctgtctttcctagggtgg

SEQ ID NO: 1191 - DNA, 119 bp, Artificial Sequence
  Description of Artificial Sequence: Synthetic polynucleotide
attctaatacgactcactataggcaatcctgtctttcctaggggttttagagctagaaatagcaagttaaaataaggctagtccgttatcaacttgaaaaagtggcaccgagtcggtgc

SEQ ID NO: 1192 - DNA, 23 bp, Artificial Sequence
  Description of Artificial Sequence: Synthetic oligonucleotide
agacaatcctgtctttcctaggg

SEQ ID NO: 1193 - DNA, 119 bp, Artificial Sequence
  Description of Artificial Sequence: Synthetic polynucleotide
attctaatacgactcactataggagacaatcctgtctttcctagttttagagctagaaatagcaagttaaaataaggctagtccgttatcaacttgaaaaagtggcaccgagtcggtgc

SEQ ID NO: 1194 - DNA, 23 bp, Artificial Sequence
  Description of Artificial Sequence: Synthetic oligonucleotide
cagaaaaatgtgtgtattgttgg

SEQ ID NO: 1195 - DNA, 119 bp, Artificial Sequence
  Description of Artificial Sequence: Synthetic polynucleotide
attctaatacgactcactataggcagaaaaatgtgtgtattgtgttttagagctagaaatagcaagttaaaataaggctagtccgttatcaacttgaaaaagtggcaccgagtcggtgc

SEQ ID NO: 1196 - DNA, 23 bp, Artificial Sequence
  Description of Artificial Sequence: Synthetic oligonucleotide
ggaatacagttggctgatgttgg

SEQ ID NO: 1197 - DNA, 119 bp, Artificial Sequence
  Description of Artificial Sequence: Synthetic polynucleotide
attctaatacgactcactataggggaatacagttggctgatgtgttttagagctagaaatagcaagttaaaataaggctagtccgttatcaacttgaaaaagtggcaccgagtcggtgc

SEQ ID NO: 1198 - DNA, 21 bp, Homo sapiens
ttggctgatggtggatggctc

SEQ ID NO: 1199 - DNA, 21 bp, Artificial Sequence
  Description of Artificial Sequence: Synthetic oligonucleotide
ttggctgatgttggatggctc

SEQ ID NO: 1200 - DNA, 23 bp, Artificial Sequence
  Description of Artificial Sequence: Synthetic oligonucleotide
tacagttggctgatgttggatgg

SEQ ID NO: 1201 - DNA, 119 bp, Artificial Sequence
  Description of Artificial Sequence: Synthetic polynucleotide
attctaatacgactcactataggtacagttggctgatgttggagttttagagctagaaatagcaagttaaaataaggctagtccgttatcaacttgaaaaagtggcaccgagtcggtgc

SEQ ID NO: 1202 - DNA, 23 bp, Artificial Sequence
  Description of Artificial Sequence: Synthetic oligonucleotide
gatgggggggctgcgggccctgg

SEQ ID NO: 1203 - DNA, 119 bp, Artificial Sequence
  Description of Artificial Sequence: Synthetic polynucleotide
attctaatacgactcactatagggatgggggggctgcgggcccgttttagagctagaaatagcaagttaaaataaggctagtccgttatcaacttgaaaaagtggcaccgagtcggtgc

SEQ ID NO: 1204 - DNA, 21 bp, Homo sapiens
ggggggctgctggccctgggg

SEQ ID NO: 1205 - DNA, 21 bp, Artificial Sequence
  Description of Artificial Sequence: Synthetic oligonucleotide
ggggggctgcgggccctgggg

SEQ ID NO: 1206 - DNA, 23 bp, Artificial Sequence
  Description of Artificial Sequence: Synthetic oligonucleotide
gggggctgcgggccctggggtgg

SEQ ID NO: 1207 - DNA, 119 bp, Artificial Sequence
  Description of Artificial Sequence: Synthetic polynucleotide
attctaatacgactcactatagggggggctgcgggccctgggggttttagagctagaaatagcaagttaaaataaggctagtccgttatcaacttgaaaaagtggcaccgagtcggtgc

SEQ ID NO: 1208 - DNA, 23 bp, Artificial Sequence
  Description of Artificial Sequence: Synthetic oligonucleotide
gggggcggatgggggggctgcgg

SEQ ID NO: 1209 - DNA, 119 bp, Artificial Sequence
  Description of Artificial Sequence: Synthetic polynucleotide
attctaatacgactcactatagggggggcggatgggggggctggttttagagctagaaatagcaagttaaaataaggctagtccgttatcaacttgaaaaagtggcaccgagtcggtgc

SEQ ID NO: 1210 - DNA, 23 bp, Artificial Sequence
  Description of Artificial Sequence: Synthetic oligonucleotide
ggctgcgggccctggggtggcgg

SEQ ID NO: 1211 - DNA, 119 bp, Artificial Sequence
  Description of Artificial Sequence: Synthetic polynucleotide
attctaatacgactcactataggggctgcgggccctggggtgggttttagagctagaaatagcaagttaaaataaggctagtccgttatcaacttgaaaaagtggcaccgagtcggtgc

SEQ ID NO: 1212 - DNA, 23 bp, Artificial Sequence
  Description of Artificial Sequence: Synthetic oligonucleotide
ggggcggatgggggggctgcggg

SEQ ID NO: 1213 - DNA, 119 bp, Artificial Sequence
  Description of Artificial Sequence: Synthetic polynucleotide
attctaatacgactcactataggggggcggatgggggggctgcgttttagagctagaaatagcaagttaaaataaggctagtccgttatcaacttgaaaaagtggcaccgagtcggtgc

SEQ ID NO: 1214 - DNA, 23 bp, Artificial Sequence
  Description of Artificial Sequence: Synthetic oligonucleotide
atgggggggctgcgggccctggg

SEQ ID NO: 1215 - DNA, 119 bp, Artificial Sequence
  Description of Artificial Sequence: Synthetic polynucleotide
attctaatacgactcactataggatgggggggctgcgggccctgttttagagctagaaatagcaagttaaaataaggctagtccgttatcaacttgaaaaagtggcaccgagtcggtgc

SEQ ID NO: 1216 - DNA, 23 bp, Artificial Sequence
  Description of Artificial Sequence: Synthetic oligonucleotide
tgggggggctgcgggccctgggg

SEQ ID NO: 1217 - DNA, 119 bp, Artificial Sequence
  Description of Artificial Sequence: Synthetic polynucleotide
attctaatacgactcactataggtgggggggctgcgggccctggttttagagctagaaatagcaagttaaaataaggctagtccgttatcaacttgaaaaagtggcaccgagtcggtgc

SEQ ID NO: 1218 - DNA, 23 bp, Artificial Sequence
  Description of Artificial Sequence: Synthetic oligonucleotide
gctgcgggccctggggtggcggg

SEQ ID NO: 1219 - DNA, 119 bp, Artificial Sequence
  Description of Artificial Sequence: Synthetic polynucleotide
attctaatacgactcactatagggctgcgggccctggggtggcgttttagagctagaaatagcaagttaaaataaggctagtccgttatcaacttgaaaaagtggcaccgagtcggtgc

SEQ ID NO: 1220 - DNA, 23 bp, Artificial Sequence
  Description of Artificial Sequence: Synthetic oligonucleotide
ctgcgggccctggggtggcgggg

SEQ ID NO: 1221 - DNA, 119 bp, Artificial Sequence
  Description of Artificial Sequence: Synthetic polynucleotide
attctaatacgactcactataggctgcgggccctggggtggcggttttagagctagaaatagcaagttaaaataaggctagtccgttatcaacttgaaaaagtggcaccgagtcggtgc

SEQ ID NO: 1222 - DNA, 23 bp, Artificial Sequence
  Description of Artificial Sequence: Synthetic oligonucleotide
tgcgggccctggggtggcggggg

SEQ ID NO: 1223 - DNA, 119 bp, Artificial Sequence
  Description of Artificial Sequence: Synthetic polynucleotide
attctaatacgactcactataggtgcgggccctggggtggcgggttttagagctagaaatagcaagttaaaataaggctagtccgttatcaacttgaaaaagtggcaccgagtcggtgc

SEQ ID NO: 1224 - DNA, 23 bp, Artificial Sequence
  Description of Artificial Sequence: Synthetic oligonucleotide
ttggggagctcttcttctagtgg

SEQ ID NO: 1225 - DNA, 119 bp, Artificial Sequence
  Description of Artificial Sequence: Synthetic polynucleotide
attctaatacgactcactataggttggggagctcttcttctaggttttagagctagaaatagcaagttaaaataaggctagtccgttatcaacttgaaaaagtggcaccgagtcggtgc

SEQ ID NO: 1226 - DNA, 21 bp, Homo sapiens
tccactagaataagagctccc

SEQ ID NO: 1227 - DNA, 21 bp, Artificial Sequence
  Description of Artificial Sequence: Synthetic oligonucleotide
tccactagaagaagagctccc

SEQ ID NO: 1228 - DNA, 23 bp, Artificial Sequence
  Description of Artificial Sequence: Synthetic oligonucleotide
taagctttttccactgcctgtgg

SEQ ID NO: 1229 - DNA, 119 bp, Artificial Sequence
  Description of Artificial Sequence: Synthetic polynucleotide
attctaatacgactcactataggtaagctttttccactgcctggttttagagctagaaatagcaagttaaaataaggctagtccgttatcaacttgaaaaagtggcaccgagtcggtgc

SEQ ID NO: 1230 - DNA, 23 bp, Artificial Sequence
  Description of Artificial Sequence: Synthetic oligonucleotide
aagctttttccactgcctgtggg

SEQ ID NO: 1231 - DNA, 119 bp, Artificial Sequence
  Description of Artificial Sequence: Synthetic polynucleotide
attctaatacgactcactataggaagctttttccactgcctgtgttttagagctagaaatagcaagttaaaataaggctagtccgttatcaacttgaaaaagtggcaccgagtcggtgc

SEQ ID NO: 1232 - DNA, 23 bp, Artificial Sequence
  Description of Artificial Sequence: Synthetic oligonucleotide
ttggagagtcccacaggcagtgg

SEQ ID NO: 1233 - DNA, 119 bp, Artificial Sequence
  Description of Artificial Sequence: Synthetic polynucleotide
attctaatacgactcactataggttggagagtcccacaggcaggttttagagctagaaatagcaagttaaaataaggctagtccgttatcaacttgaaaaagtggcaccgagtcggtgc

SEQ ID NO: 1234 - DNA, 23 bp, Artificial Sequence
  Description of Artificial Sequence: Synthetic oligonucleotide
gattcggaaccctgagtacaagg

SEQ ID NO: 1235 - DNA, 119 bp, Artificial Sequence
  Description of Artificial Sequence: Synthetic polynucleotide
attctaatacgactcactatagggattcggaaccctgagtacagttttagagctagaaatagcaagttaaaataaggctagtccgttatcaacttgaaaaagtggcaccgagtcggtgc

SEQ ID NO: 1236 - DNA, 21 bp, Homo sapiens
ccagtgattcagaaccctgag

SEQ ID NO: 1237 - DNA, 21 bp, Artificial Sequence
  Description of Artificial Sequence: Synthetic oligonucleotide
ccagtgattcggaaccctgag

SEQ ID NO: 1238 - DNA, 23 bp, Artificial Sequence
  Description of Artificial Sequence: Synthetic oligonucleotide
agtgggaacccccagtgattcgg

SEQ ID NO: 1239 - DNA, 119 bp, Artificial Sequence
  Description of Artificial Sequence: Synthetic polynucleotide
attctaatacgactcactataggagtgggaacccccagtgattgttttagagctagaaatagcaagttaaaataaggctagtccgttatcaacttgaaaaagtggcaccgagtcggtgc

SEQ ID NO: 1240 - DNA, 23 bp, Artificial Sequence
  Description of Artificial Sequence: Synthetic oligonucleotide
tactcagggttccgaatcactgg

SEQ ID NO: 1241 - DNA, 119 bp, Artificial Sequence
  Description of Artificial Sequence: Synthetic polynucleotide
attctaatacgactcactataggtactcagggttccgaatcacgttttagagctagaaatagcaagttaaaataaggctagtccgttatcaacttgaaaaagtggcaccgagtcggtgc

SEQ ID NO: 1242 - DNA, 23 bp, Artificial Sequence
  Description of Artificial Sequence: Synthetic oligonucleotide
actcagggttccgaatcactggg

SEQ ID NO: 1243 - DNA, 119 bp, Artificial Sequence
  Description of Artificial Sequence: Synthetic polynucleotide
attctaatacgactcactataggactcagggttccgaatcactgttttagagctagaaatagcaagttaaaataaggctagtccgttatcaacttgaaaaagtggcaccgagtcggtgc

SEQ ID NO: 1244 - DNA, 23 bp, Artificial Sequence
  Description of Artificial Sequence: Synthetic oligonucleotide
ctcagggttccgaatcactgggg

SEQ ID NO: 1245 - DNA, 119 bp, Artificial Sequence
  Description of Artificial Sequence: Synthetic polynucleotide
attctaatacgactcactataggctcagggttccgaatcactggttttagagctagaaatagcaagttaaaataaggctagtccgttatcaacttgaaaaagtggcaccgagtcggtgc

SEQ ID NO: 1246 - DNA, 23 bp, Artificial Sequence
  Description of Artificial Sequence: Synthetic oligonucleotide
tcagggttccgaatcactggggg

SEQ ID NO: 1247 - DNA, 119 bp, Artificial Sequence
  Description of Artificial Sequence: Synthetic polynucleotide
attctaatacgactcactataggtcagggttccgaatcactgggttttagagctagaaatagcaagttaaaataaggctagtccgttatcaacttgaaaaagtggcaccgagtcggtgc

SEQ ID NO: 1248 - DNA, 23 bp, Artificial Sequence
  Description of Artificial Sequence: Synthetic oligonucleotide
tctacgctgccccatatgtcagg

SEQ ID NO: 1249 - DNA, 119 bp, Artificial Sequence
  Description of Artificial Sequence: Synthetic polynucleotide
attctaatacgactcactataggtctacgctgccccatatgtcgttttagagctagaaatagcaagttaaaataaggctagtccgttatcaacttgaaaaagtggcaccgagtcggtgc

SEQ ID NO: 1250 - DNA, 21 bp, Homo sapiens
cgctgccccacatgtcaggtt

SEQ ID NO: 1251 - DNA, 21 bp, Artificial Sequence
  Description of Artificial Sequence: Synthetic oligonucleotide
cgctgccccatatgtcaggtt

SEQ ID NO: 1252 - DNA, 23 bp, Artificial Sequence
  Description of Artificial Sequence: Synthetic oligonucleotide
ccatatgtcaggttccaccgtgg

SEQ ID NO: 1253 - DNA, 119 bp, Artificial Sequence
  Description of Artificial Sequence: Synthetic polynucleotide
attctaatacgactcactataggccatatgtcaggttccaccggttttagagctagaaatagcaagttaaaataaggctagtccgttatcaacttgaaaaagtggcaccgagtcggtgc

SEQ ID NO: 1254 - DNA, 23 bp, Artificial Sequence
  Description of Artificial Sequence: Synthetic oligonucleotide
tgacatatggggcagcgtagagg

SEQ ID NO: 1255 - DNA, 119 bp, Artificial Sequence
  Description of Artificial Sequence: Synthetic polynucleotide
attctaatacgactcactataggtgacatatggggcagcgtaggttttagagctagaaatagcaagttaaaataaggctagtccgttatcaacttgaaaaagtggcaccgagtcggtgc

SEQ ID NO: 1256 - DNA, 23 bp, Artificial Sequence
  Description of Artificial Sequence: Synthetic oligonucleotide
ccacggtggaacctgacatatgg

SEQ ID NO: 1257 - DNA, 119 bp, Artificial Sequence
  Description of Artificial Sequence: Synthetic polynucleotide
attctaatacgactcactataggccacggtggaacctgacatagttttagagctagaaatagcaagttaaaataaggctagtccgttatcaacttgaaaaagtggcaccgagtcggtgc

SEQ ID NO: 1258 - DNA, 23 bp, Artificial Sequence
  Description of Artificial Sequence: Synthetic oligonucleotide
cacggtggaacctgacatatggg

SEQ ID NO: 1259 - DNA, 119 bp, Artificial Sequence
  Description of Artificial Sequence: Synthetic polynucleotide
attctaatacgactcactataggcacggtggaacctgacatatgttttagagctagaaatagcaagttaaaataaggctagtccgttatcaacttgaaaaagtggcaccgagtcggtgc

SEQ ID NO: 1260 - DNA, 23 bp, Artificial Sequence
  Description of Artificial Sequence: Synthetic oligonucleotide
acggtggaacctgacatatgggg

SEQ ID NO: 1261 - DNA, 119 bp, Artificial Sequence
  Description of Artificial Sequence: Synthetic polynucleotide
attctaatacgactcactataggacggtggaacctgacatatggttttagagctagaaatagcaagttaaaataaggctagtccgttatcaacttgaaaaagtggcaccgagtcggtgc

SEQ ID NO: 1262 - DNA, 23 bp, Artificial Sequence
  Description of Artificial Sequence: Synthetic oligonucleotide
gagagattatggttactggcagg

SEQ ID NO: 1263 - DNA, 119 bp, Artificial Sequence
  Description of Artificial Sequence: Synthetic polynucleotide
attctaatacgactcactatagggagagattatggttactggcgttttagagctagaaatagcaagttaaaataaggctagtccgttatcaacttgaaaaagtggcaccgagtcggtgc

SEQ ID NO: 1264 - DNA, 21 bp, Homo sapiens
cctgagagatgatggttactg

SEQ ID NO: 1265 - DNA, 21 bp, Artificial Sequence
  Description of Artificial Sequence: Synthetic oligonucleotide
cctgagagattatggttactg

SEQ ID NO: 1266 - DNA, 23 bp, Artificial Sequence
  Description of Artificial Sequence: Synthetic oligonucleotide
cccaaagtcctgagagattatgg

SEQ ID NO: 1267 - DNA, 119 bp, Artificial Sequence
  Description of Artificial Sequence: Synthetic polynucleotide
attctaatacgactcactataggcccaaagtcctgagagattagttttagagctagaaatagcaagttaaaataaggctagtccgttatcaacttgaaaaagtggcaccgagtcggtgc

SEQ ID NO: 1268 - DNA, 23 bp, Artificial Sequence
  Description of Artificial Sequence: Synthetic oligonucleotide
tcctgagagattatggttactgg

SEQ ID NO: 1269 - DNA, 119 bp, Artificial Sequence
  Description of Artificial Sequence: Synthetic polynucleotide
attctaatacgactcactataggtcctgagagattatggttacgttttagagctagaaatagcaagttaaaataaggctagtccgttatcaacttgaaaaagtggcaccgagtcggtgc

SEQ ID NO: 1270 - DNA, 23 bp, Artificial Sequence
  Description of Artificial Sequence: Synthetic oligonucleotide
tatggttactggcaggttcctgg

SEQ ID NO: 1271 - DNA, 119 bp, Artificial Sequence
  Description of Artificial Sequence: Synthetic polynucleotide
attctaatacgactcactataggtatggttactggcaggttccgttttagagctagaaatagcaagttaaaataaggctagtccgttatcaacttgaaaaagtggcaccgagtcggtgc

SEQ ID NO: 1272 - DNA, 23 bp, Artificial Sequence
  Description of Artificial Sequence: Synthetic oligonucleotide
gccagtaaccataatctctcagg

SEQ ID NO: 1273 - DNA, 119 bp, Artificial Sequence
  Description of Artificial Sequence: Synthetic polynucleotide
attctaatacgactcactatagggccagtaaccataatctctcgttttagagctagaaatagcaagttaaaataaggctagtccgttatcaacttgaaaaagtggcaccgagtcggtgc

SEQ ID NO: 1274 - DNA, 23 bp, Artificial Sequence
  Description of Artificial Sequence: Synthetic oligonucleotide
accataatctctcaggactttgg

SEQ ID NO: 1275 - DNA, 119 bp, Artificial Sequence
  Description of Artificial Sequence: Synthetic polynucleotide
attctaatacgactcactataggaccataatctctcaggacttgttttagagctagaaatagcaagttaaaataaggctagtccgttatcaacttgaaaaagtggcaccgagtcggtgc

SEQ ID NO: 1276 - DNA, 23 bp, Artificial Sequence
  Description of Artificial Sequence: Synthetic oligonucleotide
ccataatctctcaggactttggg

SEQ ID NO: 1277 - DNA, 119 bp, Artificial Sequence
  Description of Artificial Sequence: Synthetic polynucleotide
attctaatacgactcactataggccataatctctcaggactttgttttagagctagaaatagcaagttaaaataaggctagtccgttatcaacttgaaaaagtggcaccgagtcggtgc

SEQ ID NO: 1278 - DNA, 23 bp, Artificial Sequence
  Description of Artificial Sequence: Synthetic oligonucleotide
cataatctctcaggactttgggg

SEQ ID NO: 1279 - DNA, 119 bp, Artificial Sequence
  Description of Artificial Sequence: Synthetic polynucleotide
attctaatacgactcactataggcataatctctcaggactttggttttagagctagaaatagcaagttaaaataaggctagtccgttatcaacttgaaaaagtggcaccgagtcggtgc

SEQ ID NO: 1280 - DNA, 23 bp, Artificial Sequence
  Description of Artificial Sequence: Synthetic oligonucleotide
gagggggtggcagcctgttgagg

SEQ ID NO: 1281 - DNA, 119 bp, Artificial Sequence
  Description of Artificial Sequence: Synthetic polynucleotide
attctaatacgactcactatagggagggggtggcagcctgttggttttagagctagaaatagcaagttaaaataaggctagtccgttatcaacttgaaaaagtggcaccgagtcggtgc

SEQ ID NO: 1282 - DNA, 23 bp, Artificial Sequence
  Description of Artificial Sequence: Synthetic oligonucleotide
ggtggcagcctgttgaggcaagg

SEQ ID NO: 1283 - DNA, 119 bp, Artificial Sequence
  Description of Artificial Sequence: Synthetic polynucleotide
attctaatacgactcactataggggtggcagcctgttgaggcagttttagagctagaaatagcaagttaaaataaggctagtccgttatcaacttgaaaaagtggcaccgagtcggtgc

SEQ ID NO: 1284 - DNA, 23 bp, Artificial Sequence
  Description of Artificial Sequence: Synthetic oligonucleotide
ccgtttgatcctagagggggtgg

SEQ ID NO: 1285 - DNA, 119 bp, Artificial Sequence
  Description of Artificial Sequence: Synthetic polynucleotide
attctaatacgactcactataggccgtttgatcctagaggggggttttagagctagaaatagcaagttaaaataaggctagtccgttatcaacttgaaaaagtggcaccgagtcggtgc

SEQ ID NO: 1286 - DNA, 23 bp, Artificial Sequence
  Description of Artificial Sequence: Synthetic oligonucleotide
gatccgtttgatcctagaggggg

SEQ ID NO: 1287 - DNA, 119 bp, Artificial Sequence
  Description of Artificial Sequence: Synthetic polynucleotide
attctaatacgactcactatagggatccgtttgatcctagagggttttagagctagaaatagcaagttaaaataaggctagtccgttatcaacttgaaaaagtggcaccgagtcggtgc

SEQ ID NO: 1288 - DNA, 23 bp, Artificial Sequence
  Description of Artificial Sequence: Synthetic oligonucleotide
aacaggctgccaccccctctagg

SEQ ID NO: 1289 - DNA, 119 bp, Artificial Sequence
  Description of Artificial Sequence: Synthetic polynucleotide
attctaatacgactcactataggaacaggctgccaccccctctgttttagagctagaaatagcaagttaaaataaggctagtccgttatcaacttgaaaaagtggcaccgagtcggtgc

SEQ ID NO: 1290 - DNA, 23 bp, Artificial Sequence
  Description of Artificial Sequence: Synthetic oligonucleotide
ccaccccctctaggatcaaacgg

SEQ ID NO: 1291 - DNA, 119 bp, Artificial Sequence
  Description of Artificial Sequence: Synthetic polynucleotide
attctaatacgactcactataggccaccccctctaggatcaaagttttagagctagaaatagcaagttaaaataaggctagtccgttatcaacttgaaaaagtggcaccgagtcggtgc

SEQ ID NO: 1292 - DNA, 23 bp, Artificial Sequence
  Description of Artificial Sequence: Synthetic oligonucleotide
tctggagactcacttgtggtagg

SEQ ID NO: 1293 - DNA, 119 bp, Artificial Sequence
  Description of Artificial Sequence: Synthetic polynucleotide
attctaatacgactcactataggtctggagactcacttgtggtgttttagagctagaaatagcaagttaaaataaggctagtccgttatcaacttgaaaaagtggcaccgagtcggtgc

SEQ ID NO: 1294 - DNA, 21 bp, Homo sapiens
gtgatcctacaacaagtgagt

SEQ ID NO: 1295 - DNA, 21 bp, Artificial Sequence
  Description of Artificial Sequence: Synthetic oligonucleotide
gtgatcctaccacaagtgagt

SEQ ID NO: 1296 - DNA, 23 bp, Artificial Sequence
  Description of Artificial Sequence: Synthetic oligonucleotide
gtagtctggagactcacttgtgg

SEQ ID NO: 1297 - DNA, 119 bp, Artificial Sequence
  Description of Artificial Sequence: Synthetic polynucleotide
attctaatacgactcactatagggtagtctggagactcacttggttttagagctagaaatagcaagttaaaataaggctagtccgttatcaacttgaaaaagtggcaccgagtcggtgc

SEQ ID NO: 1298 - DNA, 23 bp, Artificial Sequence
  Description of Artificial Sequence: Synthetic oligonucleotide
tttcaccgaaggccggaaccagg

SEQ ID NO: 1299 - DNA, 119 bp, Artificial Sequence
  Description of Artificial Sequence: Synthetic polynucleotide
attctaatacgactcactataggtttcaccgaaggccggaaccgttttagagctagaaatagcaagttaaaataaggctagtccgttatcaacttgaaaaagtggcaccgagtcggtgc

SEQ ID NO: 1300 - DNA, 23 bp, Artificial Sequence
  Description of Artificial Sequence: Synthetic oligonucleotide
ttcaccgaaggccggaaccaggg

SEQ ID NO: 1301 - DNA, 119 bp, Artificial Sequence
  Description of Artificial Sequence: Synthetic polynucleotide
attctaatacgactcactataggttcaccgaaggccggaaccagttttagagctagaaatagcaagttaaaataaggctagtccgttatcaacttgaaaaagtggcaccgagtcggtgc

SEQ ID NO: 1302 - DNA, 23 bp, Artificial Sequence
  Description of Artificial Sequence: Synthetic oligonucleotide
cataggcgctgccctggttccgg

SEQ ID NO: 1303 - DNA, 119 bp, Artificial Sequence
  Description of Artificial Sequence: Synthetic polynucleotide
attctaatacgactcactataggcataggcgctgccctggttcgttttagagctagaaatagcaagttaaaataaggctagtccgttatcaacttgaaaaagtggcaccgagtcggtgc

SEQ ID NO: 1304 - DNA, 23 bp, Artificial Sequence
  Description of Artificial Sequence: Synthetic oligonucleotide
gctgccctggttccggccttcgg

SEQ ID NO: 1305 - DNA, 119 bp, Artificial Sequence
  Description of Artificial Sequence: Synthetic polynucleotide
attctaatacgactcactatagggctgccctggttccggccttgttttagagctagaaatagcaagttaaaataaggctagtccgttatcaacttgaaaaagtggcaccgagtcggtgc

SEQ ID NO: 1306 - DNA, 23 bp, Artificial Sequence
  Description of Artificial Sequence: Synthetic oligonucleotide
agatcatcagtcctcaactgagg

SEQ ID NO: 1307 - DNA, 119 bp, Artificial Sequence
  Description of Artificial Sequence: Synthetic polynucleotide
attctaatacgactcactataggagatcatcagtcctcaactggttttagagctagaaatagcaagttaaaataaggctagtccgttatcaacttgaaaaagtggcaccgagtcggtgc

SEQ ID NO: 1308 - DNA, 21 bp, Homo sapiens
tcagtcctcacctgagggacc

SEQ ID NO: 1309 - DNA, 21 bp, Artificial Sequence
  Description of Artificial Sequence: Synthetic oligonucleotide
tcagtcctcaactgagggacc

SEQ ID NO: 1310 - DNA, 23 bp, Artificial Sequence
  Description of Artificial Sequence: Synthetic oligonucleotide
ctcaactgagggaccttccgcgg

SEQ ID NO: 1311 - DNA, 119 bp, Artificial Sequence
  Description of Artificial Sequence: Synthetic polynucleotide
attctaatacgactcactataggctcaactgagggaccttccggttttagagctagaaatagcaagttaaaataaggctagtccgttatcaacttgaaaaagtggcaccgagtcggtgc

SEQ ID NO: 1312 - DNA, 23 bp, Artificial Sequence
  Description of Artificial Sequence: Synthetic oligonucleotide
gatcatcagtcctcaactgaggg

SEQ ID NO: 1313 - DNA, 119 bp, Artificial Sequence
  Description of Artificial Sequence: Synthetic polynucleotide
attctaatacgactcactatagggatcatcagtcctcaactgagttttagagctagaaatagcaagttaaaataaggctagtccgttatcaacttgaaaaagtggcaccgagtcggtgc

SEQ ID NO: 1314 - DNA, 23 bp, Artificial Sequence
  Description of Artificial Sequence: Synthetic oligonucleotide
cgcggaaggtccctcagttgagg

SEQ ID NO: 1315 - DNA, 119 bp, Artificial Sequence
  Description of Artificial Sequence: Synthetic polynucleotide
attctaatacgactcactataggcgcggaaggtccctcagttggttttagagctagaaatagcaagttaaaataaggctagtccgttatcaacttgaaaaagtggcaccgagtcggtgc

SEQ ID NO: 1316 - DNA, 23 bp, Artificial Sequence
  Description of Artificial Sequence: Synthetic oligonucleotide
cgcagttgggctacgcgccgtgg

SEQ ID NO: 1317 - DNA, 119 bp, Artificial Sequence
  Description of Artificial Sequence: Synthetic polynucleotide
attctaatacgactcactataggcgcagttgggctacgcgccggttttagagctagaaatagcaagttaaaataaggctagtccgttatcaacttgaaaaagtggcaccgagtcggtgc

SEQ ID NO: 1318 - DNA, 21 bp, Homo sapiens
cagttgggctccgcgccgtgg

SEQ ID NO: 1319 - DNA, 21 bp, Artificial Sequence
  Description of Artificial Sequence: Synthetic oligonucleotide
cagttgggctacgcgccgtgg

SEQ ID NO: 1320 - DNA, 23 bp, Artificial Sequence
  Description of Artificial Sequence: Synthetic oligonucleotide
ccacctcctctacccgaccccgg

SEQ ID NO: 1321 - DNA, 119 bp, Artificial Sequence
  Description of Artificial Sequence: Synthetic polynucleotide
attctaatacgactcactataggccacctcctctacccgacccgttttagagctagaaatagcaagttaaaataaggctagtccgttatcaacttgaaaaagtggcaccgagtcggtgc

SEQ ID NO: 1322 - DNA, 18 bp, Homo sapiens
cgcctccagcagcgcccg

SEQ ID NO: 1323 - protein, 6 aa, Homo sapiens
RALLEA

SEQ ID NO: 1324 - DNA, 38 bp, Homo sapiens
gcagcgcccccgcctccagcagcgcccgcacctcctct

SEQ ID NO: 1325 - DNA, 20 bp, Artificial Sequence
  Description of Artificial Sequence: Synthetic oligonucleotide
gcagcgcccccacctcctct

SEQ ID NO: 1326 - DNA, 23 bp, Artificial Sequence
  Description of Artificial Sequence: Synthetic oligonucleotide
ccggggtcgggtagaggaggtgg

SEQ ID NO: 1327 - DNA, 119 bp, Artificial Sequence
  Description of Artificial Sequence: Synthetic polynucleotide
attctaatacgactcactataggccggggtcgggtagaggagggttttagagctagaaatagcaagttaaaataaggctagtccgttatcaacttgaaaaagtggcaccgagtcggtgc

SEQ ID NO: 1328 - DNA, 23 bp, Artificial Sequence
  Description of Artificial Sequence: Synthetic oligonucleotide
cggggtcgggtagaggaggtggg

SEQ ID NO: 1329 - DNA, 119 bp, Artificial Sequence
  Description of Artificial Sequence: Synthetic polynucleotide
attctaatacgactcactataggcggggtcgggtagaggaggtgttttagagctagaaatagcaagttaaaataaggctagtccgttatcaacttgaaaaagtggcaccgagtcggtgc

SEQ ID NO: 1330 - DNA, 23 bp, Artificial Sequence
  Description of Artificial Sequence: Synthetic oligonucleotide
ggggtcgggtagaggaggtgggg

SEQ ID NO: 1331 - DNA, 119 bp, Artificial Sequence
  Description of Artificial Sequence: Synthetic polynucleotide
attctaatacgactcactataggggggtcgggtagaggaggtggttttagagctagaaatagcaagttaaaataaggctagtccgttatcaacttgaaaaagtggcaccgagtcggtgc

SEQ ID NO: 1332 - DNA, 23 bp, Artificial Sequence
  Description of Artificial Sequence: Synthetic oligonucleotide
gggtcgggtagaggaggtggggg

SEQ ID NO: 1333 - DNA, 119 bp, Artificial Sequence
  Description of Artificial Sequence: Synthetic polynucleotide
attctaatacgactcactatagggggtcgggtagaggaggtgggttttagagctagaaatagcaagttaaaataaggctagtccgttatcaacttgaaaaagtggcaccgagtcggtgc

SEQ ID NO: 1334 - DNA, 23 bp, Artificial Sequence
  Description of Artificial Sequence: Synthetic oligonucleotide
cattcccgtggtgtcctttgagg

SEQ ID NO: 1335 - DNA, 119 bp, Artificial Sequence
  Description of Artificial Sequence: Synthetic polynucleotide
attctaatacgactcactataggcattcccgtggtgtcctttggttttagagctagaaatagcaagttaaaataaggctagtccgttatcaacttgaaaaagtggcaccgagtcggtgc

SEQ ID NO: 1336 - DNA, 21 bp, Homo sapiens
attcccgtggggtcctttgag

SEQ ID NO: 1337 - DNA, 21 bp, Artificial Sequence
  Description of Artificial Sequence: Synthetic oligonucleotide
attcccgtggtgtcctttgag

SEQ ID NO: 1338 - DNA, 23 bp, Artificial Sequence
  Description of Artificial Sequence: Synthetic oligonucleotide
cccgtggtgtcctttgaggcagg

SEQ ID NO: 1339 - DNA, 119 bp, Artificial Sequence
  Description of Artificial Sequence: Synthetic polynucleotide
attctaatacgactcactataggcccgtggtgtcctttgaggcgttttagagctagaaatagcaagttaaaataaggctagtccgttatcaacttgaaaaagtggcaccgagtcggtgc

SEQ ID NO: 1340 - DNA, 23 bp, Artificial Sequence
  Description of Artificial Sequence: Synthetic oligonucleotide
aaaggacaccacgggaatgctgg

SEQ ID NO: 1341 - DNA, 119 bp, Artificial Sequence
  Description of Artificial Sequence: Synthetic polynucleotide
attctaatacgactcactataggaaaggacaccacgggaatgcgttttagagctagaaatagcaagttaaaataaggctagtccgttatcaacttgaaaaagtggcaccgagtcggtgc

SEQ ID NO: 1342 - DNA, 23 bp, Artificial Sequence
  Description of Artificial Sequence: Synthetic oligonucleotide
caccacgggaatgctggcgatgg

SEQ ID NO: 1343 - DNA, 119 bp, Artificial Sequence
  Description of Artificial Sequence: Synthetic polynucleotide
attctaatacgactcactataggcaccacgggaatgctggcgagttttagagctagaaatagcaagttaaaataaggctagtccgttatcaacttgaaaaagtggcaccgagtcggtgc

SEQ ID NO: 1344 - DNA, 23 bp, Artificial Sequence
  Description of Artificial Sequence: Synthetic oligonucleotide
acctgcctcaaaggacaccacgg

SEQ ID NO: 1345 - DNA, 119 bp, Artificial Sequence
  Description of Artificial Sequence: Synthetic polynucleotide
attctaatacgactcactataggacctgcctcaaaggacaccagttttagagctagaaatagcaagttaaaataaggctagtccgttatcaacttgaaaaagtggcaccgagtcggtgc

SEQ ID NO: 1346 - DNA, 23 bp, Artificial Sequence
  Description of Artificial Sequence: Synthetic oligonucleotide
cctgcctcaaaggacaccacggg

SEQ ID NO: 1347 - DNA, 119 bp, Artificial Sequence
  Description of Artificial Sequence: Synthetic polynucleotide
attctaatacgactcactataggcctgcctcaaaggacaccacgttttagagctagaaatagcaagttaaaataaggctagtccgttatcaacttgaaaaagtggcaccgagtcggtgc

SEQ ID NO: 1348 - DNA, 23 bp, Artificial Sequence
  Description of Artificial Sequence: Synthetic oligonucleotide
gcattggcaagcttgggctcagg

SEQ ID NO: 1349 - DNA, 119 bp, Artificial Sequence
  Description of Artificial Sequence: Synthetic polynucleotide
attctaatacgactcactatagggcattggcaagcttgggctcgttttagagctagaaatagcaagttaaaataaggctagtccgttatcaacttgaaaaagtggcaccgagtcggtgc

SEQ ID NO: 1350 - DNA, 21 bp, Homo sapiens
tggtagcattagcaagcttgg

SEQ ID NO: 1351 - DNA, 21 bp, Artificial Sequence
  Description of Artificial Sequence: Synthetic oligonucleotide
tggtagcattggcaagcttgg

SEQ ID NO: 1352 - DNA, 23 bp, Artificial Sequence
  Description of Artificial Sequence: Synthetic oligonucleotide
tgtgtccttggtggtagcattgg

SEQ ID NO: 1353 - DNA, 119 bp, Artificial Sequence
  Description of Artificial Sequence: Synthetic polynucleotide
attctaatacgactcactataggtgtgtccttggtggtagcatgttttagagctagaaatagcaagttaaaataaggctagtccgttatcaacttgaaaaagtggcaccgagtcggtgc

SEQ ID NO: 1354 - DNA, 23 bp, Artificial Sequence
  Description of Artificial Sequence: Synthetic oligonucleotide
ggtggtagcattggcaagcttgg

SEQ ID NO: 1355 - DNA, 119 bp, Artificial Sequence
  Description of Artificial Sequence: Synthetic polynucleotide
attctaatacgactcactataggggtggtagcattggcaagctgttttagagctagaaatagcaagttaaaataaggctagtccgttatcaacttgaaaaagtggcaccgagtcggtgc

SEQ ID NO: 1356 - DNA, 23 bp, Artificial Sequence
  Description of Artificial Sequence: Synthetic oligonucleotide
tggcaagcttgggctcaggctgg

SEQ ID NO: 1357 - DNA, 119 bp, Artificial Sequence
  Description of Artificial Sequence: Synthetic polynucleotide
attctaatacgactcactataggtggcaagcttgggctcaggcgttttagagctagaaatagcaagttaaaataaggctagtccgttatcaacttgaaaaagtggcaccgagtcggtgc

SEQ ID NO: 1358 - DNA, 23 bp, Artificial Sequence
  Description of Artificial Sequence: Synthetic oligonucleotide
gtggtagcattggcaagcttggg

SEQ ID NO: 1359 - DNA, 119 bp, Artificial Sequence
  Description of Artificial Sequence: Synthetic polynucleotide
attctaatacgactcactatagggtggtagcattggcaagcttgttttagagctagaaatagcaagttaaaataaggctagtccgttatcaacttgaaaaagtggcaccgagtcggtgc

SEQ ID NO: 1360 - DNA, 23 bp, Artificial Sequence
  Description of Artificial Sequence: Synthetic oligonucleotide
gcttgccaatgctaccaccaagg

SEQ ID NO: 1361 - DNA, 119 bp, Artificial Sequence
  Description of Artificial Sequence: Synthetic polynucleotide
attctaatacgactcactatagggcttgccaatgctaccaccagttttagagctagaaatagcaagttaaaataaggctagtccgttatcaacttgaaaaagtggcaccgagtcggtgc

SEQ ID NO: 1362 - DNA, 23 bp, Artificial Sequence
  Description of Artificial Sequence: Synthetic oligonucleotide
catcacctccttgccccgttcgg

SEQ ID NO: 1363 - DNA, 119 bp, Artificial Sequence
  Description of Artificial Sequence: Synthetic polynucleotide
attctaatacgactcactataggcatcacctccttgccccgttgttttagagctagaaatagcaagttaaaataaggctagtccgttatcaacttgaaaaagtggcaccgagtcggtgc

SEQ ID NO: 1364 - DNA, 21 bp, Homo sapiens
tcacctccttaccccgttcgg

SEQ ID NO: 1365 - DNA, 21 bp, Artificial Sequence
  Description of Artificial Sequence: Synthetic oligonucleotide
tcacctccttgccccgttcgg

SEQ ID NO: 1366 - DNA, 23 bp, Artificial Sequence
  Description of Artificial Sequence: Synthetic oligonucleotide
gagaactaccgaacggggcaagg

SEQ ID NO: 1367 - DNA, 119 bp, Artificial Sequence
  Description of Artificial Sequence: Synthetic polynucleotide
attctaatacgactcactatagggagaactaccgaacggggcagttttagagctagaaatagcaagttaaaataaggctagtccgttatcaacttgaaaaagtggcaccgagtcggtgc

SEQ ID NO: 1368 - DNA, 23 bp, Artificial Sequence
  Description of Artificial Sequence: Synthetic oligonucleotide
aactaccgaacggggcaaggagg

SEQ ID NO: 1369 - DNA, 119 bp, Artificial Sequence
  Description of Artificial Sequence: Synthetic polynucleotide
attctaatacgactcactataggaactaccgaacggggcaagggttttagagctagaaatagcaagttaaaataaggctagtccgttatcaacttgaaaaagtggcaccgagtcggtgc

SEQ ID NO: 1370 - DNA, 23 bp, Artificial Sequence
  Description of Artificial Sequence: Synthetic oligonucleotide
cggggcaaggaggtgatgagagg

SEQ ID NO: 1371 - DNA, 119 bp, Artificial Sequence
  Description of Artificial Sequence: Synthetic polynucleotide
attctaatacgactcactataggcggggcaaggaggtgatgaggttttagagctagaaatagcaagttaaaataaggctagtccgttatcaacttgaaaaagtggcaccgagtcggtgc

SEQ ID NO: 1372 - DNA, 23 bp, Artificial Sequence
  Description of Artificial Sequence: Synthetic oligonucleotide
gcaaggaggtgatgagaggctgg

SEQ ID NO: 1373 - DNA, 119 bp, Artificial Sequence
  Description of Artificial Sequence: Synthetic polynucleotide
attctaatacgactcactatagggcaaggaggtgatgagaggcgttttagagctagaaatagcaagttaaaataaggctagtccgttatcaacttgaaaaagtggcaccgagtcggtgc

SEQ ID NO: 1374 - DNA, 23 bp, Artificial Sequence
  Description of Artificial Sequence: Synthetic oligonucleotide
caaggaggtgatgagaggctggg

SEQ ID NO: 1375 - DNA, 119 bp, Artificial Sequence
  Description of Artificial Sequence: Synthetic polynucleotide
attctaatacgactcactataggcaaggaggtgatgagaggctgttttagagctagaaatagcaagttaaaataaggctagtccgttatcaacttgaaaaagtggcaccgagtcggtgc

SEQ ID NO: 1376 - DNA, 23 bp, Artificial Sequence
  Description of Artificial Sequence: Synthetic oligonucleotide
acaagaagtagaaataatattgg

SEQ ID NO: 1377 - DNA, 119 bp, Artificial Sequence
  Description of Artificial Sequence: Synthetic polynucleotide
attctaatacgactcactataggacaagaagtagaaataatatgttttagagctagaaatagcaagttaaaataaggctagtccgttatcaacttgaaaaagtggcaccgagtcggtgc

SEQ ID NO: 1378 - DNA, 23 bp, Artificial Sequence
  Description of Artificial Sequence: Synthetic oligonucleotide
aataatattggataaagcaatgg

SEQ ID NO: 1379 - DNA, 119 bp, Artificial Sequence
  Description of Artificial Sequence: Synthetic polynucleotide
attctaatacgactcactataggaataatattggataaagcaagttttagagctagaaatagcaagttaaaataaggctagtccgttatcaacttgaaaaagtggcaccgagtcggtgc

SEQ ID NO: 1380 - DNA, 23 bp, Artificial Sequence
  Description of Artificial Sequence: Synthetic oligonucleotide
aaatcttgtacataccttcaagg

SEQ ID NO: 1381 - DNA, 119 bp, Artificial Sequence
  Description of Artificial Sequence: Synthetic polynucleotide
attctaatacgactcactataggaaatcttgtacataccttcagttttagagctagaaatagcaagttaaaataaggctagtccgttatcaacttgaaaaagtggcaccgagtcggtgc

SEQ ID NO: 1382 - DNA, 21 bp, Homo sapiens
aggtatgtaccagattttatg

SEQ ID NO: 1383 - DNA, 21 bp, Artificial Sequence
  Description of Artificial Sequence: Synthetic oligonucleotide
aggtatgtacaagattttatg

SEQ ID NO: 1384 - DNA, 23 bp, Artificial Sequence
  Description of Artificial Sequence: Synthetic oligonucleotide
tcacttgagcagcatgagccagg

SEQ ID NO: 1385 - DNA, 119 bp, Artificial Sequence
  Description of Artificial Sequence: Synthetic polynucleotide
attctaatacgactcactataggtcacttgagcagcatgagccgttttagagctagaaatagcaagttaaaataaggctagtccgttatcaacttgaaaaagtggcaccgagtcggtgc

SEQ ID NO: 1386 - DNA, 21 bp, Homo sapiens
agcatgagcccggagctctcc

SEQ ID NO: 1387 - DNA, 21 bp, Artificial Sequence
  Description of Artificial Sequence: Synthetic oligonucleotide
agcatgagccaggagctctcc

SEQ ID NO: 1388 - DNA, 23 bp, Artificial Sequence
  Description of Artificial Sequence: Synthetic oligonucleotide
agccaggagctctccatgaacgg

SEQ ID NO: 1389 - DNA, 119 bp, Artificial Sequence
  Description of Artificial Sequence: Synthetic polynucleotide
attctaatacgactcactataggagccaggagctctccatgaagttttagagctagaaatagcaagttaaaataaggctagtccgttatcaacttgaaaaagtggcaccgagtcggtgc

SEQ ID NO: 1390 - DNA, 23 bp, Artificial Sequence
  Description of Artificial Sequence: Synthetic oligonucleotide
tggctcatgctgctcaagtgagg

SEQ ID NO: 1391 - DNA, 119 bp, Artificial Sequence
  Description of Artificial Sequence: Synthetic polynucleotide
attctaatacgactcactataggtggctcatgctgctcaagtggttttagagctagaaatagcaagttaaaataaggctagtccgttatcaacttgaaaaagtggcaccgagtcggtgc

SEQ ID NO: 1392 - DNA, 23 bp, Artificial Sequence
  Description of Artificial Sequence: Synthetic oligonucleotide
ggccgttcatggagagctcctgg

SEQ ID NO: 1393 - DNA, 119 bp, Artificial Sequence
  Description of Artificial Sequence: Synthetic polynucleotide
attctaatacgactcactataggggccgttcatggagagctccgttttagagctagaaatagcaagttaaaataaggctagtccgttatcaacttgaaaaagtggcaccgagtcggtgc

SEQ ID NO: 1394 - DNA, 23 bp, Artificial Sequence
  Description of Artificial Sequence: Synthetic oligonucleotide
ggcggcgtcgaagccggggctgg

SEQ ID NO: 1395 - DNA, 119 bp, Artificial Sequence
  Description of Artificial Sequence: Synthetic polynucleotide
attctaatacgactcactataggggcggcgtcgaagccggggcgttttagagctagaaatagcaagttaaaataaggctagtccgttatcaacttgaaaaagtggcaccgagtcggtgc

SEQ ID NO: 1396 - DNA, 21 bp, Homo sapiens
cccggcttcgccgccgccgcc

SEQ ID NO: 1397 - DNA, 21 bp, Artificial Sequence
  Description of Artificial Sequence: Synthetic oligonucleotide
cccggcttcgacgccgccgcc

SEQ ID NO: 1398 - DNA, 23 bp, Artificial Sequence
  Description of Artificial Sequence: Synthetic oligonucleotide
ggcggcggcggcgtcgaagccgg

SEQ ID NO: 1399 - DNA, 119 bp, Artificial Sequence
  Description of Artificial Sequence: Synthetic polynucleotide
attctaatacgactcactataggggcggcggcggcgtcgaagcgttttagagctagaaatagcaagttaaaataaggctagtccgttatcaacttgaaaaagtggcaccgagtcggtgc

SEQ ID NO: 1400 - DNA, 23 bp, Artificial Sequence
  Description of Artificial Sequence: Synthetic oligonucleotide
gcggcggcggcgtcgaagccggg

SEQ ID NO: 1401 - DNA, 119 bp, Artificial Sequence
  Description of Artificial Sequence: Synthetic polynucleotide
attctaatacgactcactatagggcggcggcggcgtcgaagccgttttagagctagaaatagcaagttaaaataaggctagtccgttatcaacttgaaaaagtggcaccgagtcggtgc

SEQ ID NO: 1402 - DNA, 23 bp, Artificial Sequence
  Description of Artificial Sequence: Synthetic oligonucleotide
cggcggcggcgtcgaagccgggg

SEQ ID NO: 1403 - DNA, 119 bp, Artificial Sequence
  Description of Artificial Sequence: Synthetic polynucleotide
attctaatacgactcactataggcggcggcggcgtcgaagccggttttagagctagaaatagcaagttaaaataaggctagtccgttatcaacttgaaaaagtggcaccgagtcggtgc

SEQ ID NO: 1404 - DNA, 23 bp, Artificial Sequence
  Description of Artificial Sequence: Synthetic oligonucleotide
atcatgcagctcatgcccttcgg

SEQ ID NO: 1405 - DNA, 119 bp, Artificial Sequence
  Description of Artificial Sequence: Synthetic polynucleotide
attctaatacgactcactataggatcatgcagctcatgcccttgttttagagctagaaatagcaagttaaaataaggctagtccgttatcaacttgaaaaagtggcaccgagtcggtgc

SEQ ID NO: 1406 - DNA, 21 bp, Homo sapiens
cagctcatcacgcagctcatg

SEQ ID NO: 1407 - DNA, 21 bp, Artificial Sequence
  Description of Artificial Sequence: Synthetic oligonucleotide
cagctcatcatgcagctcatg

SEQ ID NO: 1408 - DNA, 23 bp, Artificial Sequence
  Description of Artificial Sequence: Synthetic oligonucleotide
catgatgagctgcacggtggagg

SEQ ID NO: 1409 - DNA, 119 bp, Artificial Sequence
  Description of Artificial Sequence: Synthetic polynucleotide
attctaatacgactcactataggcatgatgagctgcacggtgggttttagagctagaaatagcaagttaaaataaggctagtccgttatcaacttgaaaaagtggcaccgagtcggtgc

SEQ ID NO: 1410 - DNA, 23 bp, Artificial Sequence
  Description of Artificial Sequence: Synthetic oligonucleotide
ctgcatgatgagctgcacggtgg

SEQ ID NO: 1411 - DNA, 119 bp, Artificial Sequence
  Description of Artificial Sequence: Synthetic polynucleotide
attctaatacgactcactataggctgcatgatgagctgcacgggttttagagctagaaatagcaagttaaaataaggctagtccgttatcaacttgaaaaagtggcaccgagtcggtgc

SEQ ID NO: 1412 - DNA, 23 bp, Artificial Sequence
  Description of Artificial Sequence: Synthetic oligonucleotide
gagctgcatgatgagctgcacgg

SEQ ID NO: 1413 - DNA, 119 bp, Artificial Sequence
  Description of Artificial Sequence: Synthetic polynucleotide
attctaatacgactcactatagggagctgcatgatgagctgcagttttagagctagaaatagcaagttaaaataaggctagtccgttatcaacttgaaaaagtggcaccgagtcggtgc

SEQ ID NO: 1414 - DNA, 23 bp, Artificial Sequence
  Description of Artificial Sequence: Synthetic oligonucleotide
ttttgggcgggccaaactgctgg

SEQ ID NO: 1415 - DNA, 119 bp, Artificial Sequence
  Description of Artificial Sequence: Synthetic polynucleotide
attctaatacgactcactataggttttgggcgggccaaactgcgttttagagctagaaatagcaagttaaaataaggctagtccgttatcaacttgaaaaagtggcaccgagtcggtgc

SEQ ID NO: 1416 - DNA, 23 bp, Artificial Sequence
  Description of Artificial Sequence: Synthetic oligonucleotide
tcaagatcacagattttgggcgg

SEQ ID NO: 1417 - DNA, 119 bp, Artificial Sequence
  Description of Artificial Sequence: Synthetic polynucleotide
attctaatacgactcactataggtcaagatcacagattttggggttttagagctagaaatagcaagttaaaataaggctagtccgttatcaacttgaaaaagtggcaccgagtcggtgc

SEQ ID NO: 1418 - DNA, 23 bp, Artificial Sequence
  Description of Artificial Sequence: Synthetic oligonucleotide
gcgggccaaactgctgggtgcgg

SEQ ID NO: 1419 - DNA, 119 bp, Artificial Sequence
  Description of Artificial Sequence: Synthetic polynucleotide
attctaatacgactcactatagggcgggccaaactgctgggtggttttagagctagaaatagcaagttaaaataaggctagtccgttatcaacttgaaaaagtggcaccgagtcggtgc

SEQ ID NO: 1420 - DNA, 23 bp, Artificial Sequence
  Description of Artificial Sequence: Synthetic oligonucleotide
caagatcacagattttgggcggg

SEQ ID NO: 1421 - DNA, 119 bp, Artificial Sequence
  Description of Artificial Sequence: Synthetic polynucleotide
attctaatacgactcactataggcaagatcacagattttgggcgttttagagctagaaatagcaagttaaaataaggctagtccgttatcaacttgaaaaagtggcaccgagtcggtgc

SEQ ID NO: 1422 - DNA, 23 bp, Artificial Sequence
  Description of Artificial Sequence: Synthetic oligonucleotide
tttgggcgggccaaactgctggg

SEQ ID NO: 1423 - DNA, 119 bp, Artificial Sequence
  Description of Artificial Sequence: Synthetic polynucleotide
attctaatacgactcactataggtttgggcgggccaaactgctgttttagagctagaaatagcaagttaaaataaggctagtccgttatcaacttgaaaaagtggcaccgagtcggtgc

SEQ ID NO: 1424 - DNA, 23 bp, Artificial Sequence
  Description of Artificial Sequence: Synthetic oligonucleotide
cggagatgttttgatagcgacgg

SEQ ID NO: 1425 - DNA, 119 bp, Artificial Sequence
  Description of Artificial Sequence: Synthetic polynucleotide
attctaatacgactcactataggcggagatgttttgatagcgagttttagagctagaaatagcaagttaaaataaggctagtccgttatcaacttgaaaaagtggcaccgagtcggtgc

SEQ ID NO: 1426 - DNA, 23 bp, Artificial Sequence
  Description of Artificial Sequence: Synthetic oligonucleotide
ggagatgttttgatagcgacggg

SEQ ID NO: 1427 - DNA, 119 bp, Artificial Sequence
  Description of Artificial Sequence: Synthetic polynucleotide
attctaatacgactcactataggggagatgttttgatagcgacgttttagagctagaaatagcaagttaaaataaggctagtccgttatcaacttgaaaaagtggcaccgagtcggtgc

SEQ ID NO: 1428 - DNA, 23 bp, Artificial Sequence
  Description of Artificial Sequence: Synthetic oligonucleotide
gacatctccgaaagccaacaagg

SEQ ID NO: 1429 - DNA, 119 bp, Artificial Sequence
  Description of Artificial Sequence: Synthetic polynucleotide
attctaatacgactcactatagggacatctccgaaagccaacagttttagagctagaaatagcaagttaaaataaggctagtccgttatcaacttgaaaaagtggcaccgagtcggtgc

SEQ ID NO: 1430 - DNA, 23 bp, Artificial Sequence
  Description of Artificial Sequence: Synthetic oligonucleotide
ggagatgtcttgatagcgacggg

SEQ ID NO: 1431 - DNA, 119 bp, Artificial Sequence
  Description of Artificial Sequence: Synthetic polynucleotide
attctaatacgactcactataggggagatgtcttgatagcgacgttttagagctagaaatagcaagttaaaataaggctagtccgttatcaacttgaaaaagtggcaccgagtcggtgc

SEQ ID NO: 1432 - DNA, 23 bp, Artificial Sequence
  Description of Artificial Sequence: Synthetic oligonucleotide
tctttacagtgcacttcaaaagg

SEQ ID NO: 1433 - DNA, 119 bp, Artificial Sequence
  Description of Artificial Sequence: Synthetic polynucleotide
attctaatacgactcactataggtctttacagtgcacttcaaagttttagagctagaaatagcaagttaaaataaggctagtccgttatcaacttgaaaaagtggcaccgagtcggtgc

SEQ ID NO: 1434 - DNA, 23 bp, Artificial Sequence
  Description of Artificial Sequence: Synthetic oligonucleotide
cgaactttcgcgtgtcctggagg

SEQ ID NO: 1435 - DNA, 119 bp, Artificial Sequence
  Description of Artificial Sequence: Synthetic polynucleotide
attctaatacgactcactataggcgaactttcgcgtgtcctgggttttagagctagaaatagcaagttaaaataaggctagtccgttatcaacttgaaaaagtggcaccgagtcggtgc

SEQ ID NO: 1436 - DNA, 23 bp, Artificial Sequence
  Description of Artificial Sequence: Synthetic oligonucleotide
tttcgaactttcgcgtgtcctgg

SEQ ID NO: 1437 - DNA, 119 bp, Artificial Sequence
  Description of Artificial Sequence: Synthetic polynucleotide
attctaatacgactcactataggtttcgaactttcgcgtgtccgttttagagctagaaatagcaagttaaaataaggctagtccgttatcaacttgaaaaagtggcaccgagtcggtgc

SEQ ID NO: 1438 - DNA, 23 bp, Artificial Sequence
  Description of Artificial Sequence: Synthetic oligonucleotide
actgccgggctcctgggctcagg

SEQ ID NO: 1439 - DNA, 119 bp, Artificial Sequence
  Description of Artificial Sequence: Synthetic polynucleotide
attctaatacgactcactataggactgccgggctcctgggctcgttttagagctagaaatagcaagttaaaataaggctagtccgttatcaacttgaaaaagtggcaccgagtcggtgc

SEQ ID NO: 1440 - DNA, 21 bp, Homo sapiens
cctgggctcaagtcggacact

SEQ ID NO: 1441 - DNA, 21 bp, Artificial Sequence
  Description of Artificial Sequence: Synthetic oligonucleotide
cctgggctcaggtcggacact

SEQ ID NO: 1442 - DNA, 23 bp, Artificial Sequence
  Description of Artificial Sequence: Synthetic oligonucleotide
ccgggctcctgggctcaggtcgg

SEQ ID NO: 1443 - DNA, 119 bp, Artificial Sequence
  Description of Artificial Sequence: Synthetic polynucleotide
attctaatacgactcactataggccgggctcctgggctcaggtgttttagagctagaaatagcaagttaaaataaggctagtccgttatcaacttgaaaaagtggcaccgagtcggtgc

SEQ ID NO: 1444 - DNA, 23 bp, Artificial Sequence
  Description of Artificial Sequence: Synthetic oligonucleotide
ggagtgtccgacctgagcccagg

SEQ ID NO: 1445 - DNA, 119 bp, Artificial Sequence
  Description of Artificial Sequence: Synthetic polynucleotide
attctaatacgactcactataggggagtgtccgacctgagcccgttttagagctagaaatagcaagttaaaataaggctagtccgttatcaacttgaaaaagtggcaccgagtcggtgc

SEQ ID NO: 1446 - DNA, 23 bp, Artificial Sequence
  Description of Artificial Sequence: Synthetic oligonucleotide
ccgacctgagcccaggagcccgg

SEQ ID NO: 1447 - DNA, 119 bp, Artificial Sequence
  Description of Artificial Sequence: Synthetic polynucleotide
attctaatacgactcactataggccgacctgagcccaggagccgttttagagctagaaatagcaagttaaaataaggctagtccgttatcaacttgaaaaagtggcaccgagtcggtgc

SEQ ID NO: 1448 - DNA, 23 bp, Artificial Sequence
  Description of Artificial Sequence: Synthetic oligonucleotide
agcagccggccagggacgcttgg

SEQ ID NO: 1449 - DNA, 119 bp, Artificial Sequence
  Description of Artificial Sequence: Synthetic polynucleotide
attctaatacgactcactataggagcagccggccagggacgctgttttagagctagaaatagcaagttaaaataaggctagtccgttatcaacttgaaaaagtggcaccgagtcggtgc

SEQ ID NO: 1450 - DNA, 21 bp, Homo sapiens
cagggacgctggggtgatggg

SEQ ID NO: 1451 - DNA, 21 bp, Artificial Sequence
  Description of Artificial Sequence: Synthetic oligonucleotide
cagggacgcttgggtgatggg

SEQ ID NO: 1452 - DNA, 23 bp, Artificial Sequence
  Description of Artificial Sequence: Synthetic oligonucleotide
ggccagggacgcttgggtgatgg

SEQ ID NO: 1453 - DNA, 119 bp, Artificial Sequence
  Description of Artificial Sequence: Synthetic polynucleotide
attctaatacgactcactataggggccagggacgcttgggtgagttttagagctagaaatagcaagttaaaataaggctagtccgttatcaacttgaaaaagtggcaccgagtcggtgc

SEQ ID NO: 1454 - DNA, 23 bp, Artificial Sequence
  Description of Artificial Sequence: Synthetic oligonucleotide
gcagccggccagggacgcttggg

SEQ ID NO: 1455 - DNA, 119 bp, Artificial Sequence
  Description of Artificial Sequence: Synthetic polynucleotide
attctaatacgactcactatagggcagccggccagggacgcttgttttagagctagaaatagcaagttaaaataaggctagtccgttatcaacttgaaaaagtggcaccgagtcggtgc

SEQ ID NO: 1456 - DNA, 23 bp, Artificial Sequence
  Description of Artificial Sequence: Synthetic oligonucleotide
gccagggacgcttgggtgatggg

SEQ ID NO: 1457 - DNA, 119 bp, Artificial Sequence
  Description of Artificial Sequence: Synthetic polynucleotide
attctaatacgactcactatagggccagggacgcttgggtgatgttttagagctagaaatagcaagttaaaataaggctagtccgttatcaacttgaaaaagtggcaccgagtcggtgc

SEQ ID NO: 1458 - DNA, 23 bp, Artificial Sequence
  Description of Artificial Sequence: Synthetic oligonucleotide
ccagggacgcttgggtgatgggg

SEQ ID NO: 1459 - DNA, 119 bp, Artificial Sequence
  Description of Artificial Sequence: Synthetic polynucleotide
attctaatacgactcactataggccagggacgcttgggtgatggttttagagctagaaatagcaagttaaaataaggctagtccgttatcaacttgaaaaagtggcaccgagtcggtgc

SEQ ID NO: 1460 - DNA, 23 bp, Artificial Sequence
  Description of Artificial Sequence: Synthetic oligonucleotide
cagggacgcttgggtgatggggg

SEQ ID NO: 1461 - DNA, 119 bp, Artificial Sequence
  Description of Artificial Sequence: Synthetic polynucleotide
attctaatacgactcactataggcagggacgcttgggtgatgggttttagagctagaaatagcaagttaaaataaggctagtccgttatcaacttgaaaaagtggcaccgagtcggtgc

SEQ ID NO: 1462 - DNA, 23 bp, Artificial Sequence
  Description of Artificial Sequence: Synthetic oligonucleotide
ccccatcacccaagcgtccctgg

SEQ ID NO: 1463 - DNA, 119 bp, Artificial Sequence
  Description of Artificial Sequence: Synthetic polynucleotide
attctaatacgactcactataggccccatcacccaagcgtcccgttttagagctagaaatagcaagttaaaataaggctagtccgttatcaacttgaaaaagtggcaccgagtcggtgc

SEQ ID NO: 1464 - DNA, 23 bp, Artificial Sequence
  Description of Artificial Sequence: Synthetic oligonucleotide
atcacccaagcgtccctggccgg

SEQ ID NO: 1465 - DNA, 119 bp, Artificial Sequence
  Description of Artificial Sequence: Synthetic polynucleotide
attctaatacgactcactataggatcacccaagcgtccctggcgttttagagctagaaatagcaagttaaaataaggctagtccgttatcaacttgaaaaagtggcaccgagtcggtgc

SEQ ID NO: 1466 - DNA, 23 bp, Artificial Sequence
  Description of Artificial Sequence: Synthetic oligonucleotide
actgttgtttaagatgtttctgg

SEQ ID NO: 1467 - DNA, 119 bp, Artificial Sequence
  Description of Artificial Sequence: Synthetic polynucleotide
attctaatacgactcactataggactgttgtttaagatgtttcgttttagagctagaaatagcaagttaaaataaggctagtccgttatcaacttgaaaaagtggcaccgagtcggtgc

SEQ ID NO: 1468 - DNA, 23 bp, Artificial Sequence
  Description of Artificial Sequence: Synthetic oligonucleotide
acagaacttgatcttggtgacgg

SEQ ID NO: 1469 - DNA, 119 bp, Artificial Sequence
  Description of Artificial Sequence: Synthetic polynucleotide
attctaatacgactcactataggacagaacttgatcttggtgagttttagagctagaaatagcaagttaaaataaggctagtccgttatcaacttgaaaaagtggcaccgagtcggtgc

SEQ ID NO: 1470 - DNA, 23 bp, Artificial Sequence
  Description of Artificial Sequence: Synthetic oligonucleotide
ttggttacacagaaaaaaaaagg

SEQ ID NO: 1471 - DNA, 119 bp, Artificial Sequence
  Description of Artificial Sequence: Synthetic polynucleotide
attctaatacgactcactataggttggttacacagaaaaaaaagttttagagctagaaatagcaagttaaaataaggctagtccgttatcaacttgaaaaagtggcaccgagtcggtgc

SEQ ID NO: 1472 - DNA, 23 bp, Artificial Sequence
  Description of Artificial Sequence: Synthetic oligonucleotide
tggtgtttatttttacatagagg

SEQ ID NO: 1473 - DNA, 119 bp, Artificial Sequence
  Description of Artificial Sequence: Synthetic polynucleotide
attctaatacgactcactataggtggtgtttatttttacataggttttagagctagaaatagcaagttaaaataaggctagtccgttatcaacttgaaaaagtggcaccgagtcggtgc

SEQ ID NO: 1474 - DNA, 23 bp, Artificial Sequence
  Description of Artificial Sequence: Synthetic oligonucleotide
gatgagtttagggatcacaatgg

SEQ ID NO: 1475 - DNA, 119 bp, Artificial Sequence
  Description of Artificial Sequence: Synthetic polynucleotide
attctaatacgactcactatagggatgagtttagggatcacaagttttagagctagaaatagcaagttaaaataaggctagtccgttatcaacttgaaaaagtggcaccgagtcggtgc

SEQ ID NO: 1476 - DNA, 23 bp, Artificial Sequence
  Description of Artificial Sequence: Synthetic oligonucleotide
agtttagggatcacaatggttgg

SEQ ID NO: 1477 - DNA, 119 bp, Artificial Sequence
  Description of Artificial Sequence: Synthetic polynucleotide
attctaatacgactcactataggagtttagggatcacaatggtgttttagagctagaaatagcaagttaaaataaggctagtccgttatcaacttgaaaaagtggcaccgagtcggtgc

SEQ ID NO: 1478 - DNA, 23 bp, Artificial Sequence
  Description of Artificial Sequence: Synthetic oligonucleotide
taagcggtgcatttgggagcagg

SEQ ID NO: 1479 - DNA, 119 bp, Artificial Sequence
  Description of Artificial Sequence: Synthetic polynucleotide
attctaatacgactcactataggtaagcggtgcatttgggagcgttttagagctagaaatagcaagttaaaataaggctagtccgttatcaacttgaaaaagtggcaccgagtcggtgc

SEQ ID NO: 1480 - DNA, 23 bp, Artificial Sequence
  Description of Artificial Sequence: Synthetic oligonucleotide
tattgtgtaagcggtgcatttgg

SEQ ID NO: 1481 - DNA, 119 bp, Artificial Sequence
  Description of Artificial Sequence: Synthetic polynucleotide
attctaatacgactcactataggtattgtgtaagcggtgcattgttttagagctagaaatagcaagttaaaataaggctagtccgttatcaacttgaaaaagtggcaccgagtcggtgc

SEQ ID NO: 1482 - DNA, 23 bp, Artificial Sequence
  Description of Artificial Sequence: Synthetic oligonucleotide
attgtgtaagcggtgcatttggg

SEQ ID NO: 1483 - DNA, 119 bp, Artificial Sequence
  Description of Artificial Sequence: Synthetic polynucleotide
attctaatacgactcactataggattgtgtaagcggtgcatttgttttagagctagaaatagcaagttaaaataaggctagtccgttatcaacttgaaaaagtggcaccgagtcggtgc

SEQ ID NO: 1484 - DNA, 23 bp, Artificial Sequence
  Description of Artificial Sequence: Synthetic oligonucleotide
aagcggtgcatttgggagcaggg

SEQ ID NO: 1485 - DNA, 119 bp, Artificial Sequence
  Description of Artificial Sequence: Synthetic polynucleotide
attctaatacgactcactataggaagcggtgcatttgggagcagttttagagctagaaatagcaagttaaaataaggctagtccgttatcaacttgaaaaagtggcaccgagtcggtgc

SEQ ID NO: 1486 - DNA, 23 bp, Artificial Sequence
  Description of Artificial Sequence: Synthetic oligonucleotide
ttctttttcagtattactgctgg

SEQ ID NO: 1487 - DNA, 119 bp, Artificial Sequence
  Description of Artificial Sequence: Synthetic polynucleotide
attctaatacgactcactataggttctttttcagtattactgcgttttagagctagaaatagcaagttaaaataaggctagtccgttatcaacttgaaaaagtggcaccgagtcggtgc

SEQ ID NO: 1488 - DNA, 23 bp, Artificial Sequence
  Description of Artificial Sequence: Synthetic oligonucleotide
aggggagttttcagactatttgg

SEQ ID NO: 1489 - DNA, 119 bp, Artificial Sequence
  Description of Artificial Sequence: Synthetic polynucleotide
attctaatacgactcactataggaggggagttttcagactattgttttagagctagaaatagcaagttaaaataaggctagtccgttatcaacttgaaaaagtggcaccgagtcggtgc

SEQ ID NO: 1490 - DNA, 23 bp, Artificial Sequence
  Description of Artificial Sequence: Synthetic oligonucleotide
tgctgcaagccctgtgcccgagg

SEQ ID NO: 1491 - DNA, 119 bp, Artificial Sequence
  Description of Artificial Sequence: Synthetic polynucleotide
attctaatacgactcactataggtgctgcaagccctgtgcccggttttagagctagaaatagcaagttaaaataaggctagtccgttatcaacttgaaaaagtggcaccgagtcggtgc

SEQ ID NO: 1492 - DNA, 21 bp, Homo sapiens
tgagaagtgcagcaagccctg

SEQ ID NO: 1493 - DNA, 21 bp, Artificial Sequence
  Description of Artificial Sequence: Synthetic oligonucleotide
tgagaagtgctgcaagccctg

SEQ ID NO: 1494 - DNA, 23 bp, Artificial Sequence
  Description of Artificial Sequence: Synthetic oligonucleotide
tcttacatttgcagcctgtaagg

SEQ ID NO: 1495 - DNA, 119 bp, Artificial Sequence
  Description of Artificial Sequence: Synthetic polynucleotide
attctaatacgactcactataggtcttacatttgcagcctgtagttttagagctagaaatagcaagttaaaataaggctagtccgttatcaacttgaaaaagtggcaccgagtcggtgc

SEQ ID NO: 1496 - DNA, 23 bp, Artificial Sequence
  Description of Artificial Sequence: Synthetic oligonucleotide
tttgcagcctgtaagggaacagg

SEQ ID NO: 1497 - DNA, 119 bp, Artificial Sequence
  Description of Artificial Sequence: Synthetic polynucleotide
attctaatacgactcactataggtttgcagcctgtaagggaacgttttagagctagaaatagcaagttaaaataaggctagtccgttatcaacttgaaaaagtggcaccgagtcggtgc

SEQ ID NO: 1498 - DNA, 23 bp, Artificial Sequence
  Description of Artificial Sequence: Synthetic oligonucleotide
gcctgtaagggaacaggctctgg

SEQ ID NO: 1499 - DNA, 119 bp, Artificial Sequence
  Description of Artificial Sequence: Synthetic polynucleotide
attctaatacgactcactatagggcctgtaagggaacaggctcgttttagagctagaaatagcaagttaaaataaggctagtccgttatcaacttgaaaaagtggcaccgagtcggtgc

SEQ ID NO: 1500 - DNA, 23 bp, Artificial Sequence
  Description of Artificial Sequence: Synthetic oligonucleotide
cttacatttgcagcctgtaaggg

SEQ ID NO: 1501 - DNA, 119 bp, Artificial Sequence
  Description of Artificial Sequence: Synthetic polynucleotide
attctaatacgactcactataggcttacatttgcagcctgtaagttttagagctagaaatagcaagttaaaataaggctagtccgttatcaacttgaaaaagtggcaccgagtcggtgc

SEQ ID NO: 1502 - DNA, 23 bp, Artificial Sequence
  Description of Artificial Sequence: Synthetic oligonucleotide
cctgtaagggaacaggctctggg

SEQ ID NO: 1503 - DNA, 119 bp, Artificial Sequence
  Description of Artificial Sequence: Synthetic polynucleotide
attctaatacgactcactataggcctgtaagggaacaggctctgttttagagctagaaatagcaagttaaaataaggctagtccgttatcaacttgaaaaagtggcaccgagtcggtgc

SEQ ID NO: 1504 - DNA, 23 bp, Artificial Sequence
  Description of Artificial Sequence: Synthetic oligonucleotide
cccagagcctgttcccttacagg

SEQ ID NO: 1505 - DNA, 119 bp, Artificial Sequence
  Description of Artificial Sequence: Synthetic polynucleotide
attctaatacgactcactataggcccagagcctgttcccttacgttttagagctagaaatagcaagttaaaataaggctagtccgttatcaacttgaaaaagtggcaccgagtcggtgc

SEQ ID NO: 1506 - DNA, 23 bp, Artificial Sequence
  Description of Artificial Sequence: Synthetic oligonucleotide
caacaagctaactttccagttgg

SEQ ID NO: 1507 - DNA, 119 bp, Artificial Sequence
  Description of Artificial Sequence: Synthetic polynucleotide
attctaatacgactcactataggcaacaagctaactttccagtgttttagagctagaaatagcaagttaaaataaggctagtccgttatcaacttgaaaaagtggcaccgagtcggtgc

SEQ ID NO: 1508 - DNA, 23 bp, Artificial Sequence
  Description of Artificial Sequence: Synthetic oligonucleotide
tgtggggattgggttccaactgg

SEQ ID NO: 1509 - DNA, 119 bp, Artificial Sequence
  Description of Artificial Sequence: Synthetic polynucleotide
attctaatacgactcactataggtgtggggattgggttccaacgttttagagctagaaatagcaagttaaaataaggctagtccgttatcaacttgaaaaagtggcaccgagtcggtgc

SEQ ID NO: 1510 - DNA, 23 bp, Artificial Sequence
  Description of Artificial Sequence: Synthetic oligonucleotide
tctgcgtgctactgtcctcttgg

SEQ ID NO: 1511 - DNA, 119 bp, Artificial Sequence
  Description of Artificial Sequence: Synthetic polynucleotide
attctaatacgactcactataggtctgcgtgctactgtcctctgttttagagctagaaatagcaagttaaaataaggctagtccgttatcaacttgaaaaagtggcaccgagtcggtgc

SEQ ID NO: 1512 - DNA, 21 bp, Homo sapiens
tgtacctctgggtgctactgt

SEQ ID NO: 1513 - DNA, 21 bp, Artificial Sequence
  Description of Artificial Sequence: Synthetic oligonucleotide
tgtacctctgcgtgctactgt

SEQ ID NO: 1514 - DNA, 23 bp, Artificial Sequence
  Description of Artificial Sequence: Synthetic oligonucleotide
aagaggacagtagcacgcagagg

SEQ ID NO: 1515 - DNA, 119 bp, Artificial Sequence
  Description of Artificial Sequence: Synthetic polynucleotide
attctaatacgactcactataggaagaggacagtagcacgcaggttttagagctagaaatagcaagttaaaataaggctagtccgttatcaacttgaaaaagtggcaccgagtcggtgc

SEQ ID NO: 1516 - DNA, 23 bp, Artificial Sequence
  Description of Artificial Sequence: Synthetic oligonucleotide
gacgcgttcagcacagaatctgg

SEQ ID NO: 1517 - DNA, 119 bp, Artificial Sequence
  Description of Artificial Sequence: Synthetic polynucleotide
attctaatacgactcactatagggacgcgttcagcacagaatcgttttagagctagaaatagcaagttaaaataaggctagtccgttatcaacttgaaaaagtggcaccgagtcggtgc

SEQ ID NO: 1518 - DNA, 21 bp, Homo sapiens
agggaccggaggcgttcagca

SEQ ID NO: 1519 - DNA, 21 bp, Artificial Sequence
  Description of Artificial Sequence: Synthetic oligonucleotide
agggaccggacgcgttcagca

SEQ ID NO: 1520 - DNA, 23 bp, Artificial Sequence
  Description of Artificial Sequence: Synthetic oligonucleotide
gattctgtgctgaacgcgtccgg

SEQ ID NO: 1521 - DNA, 119 bp, Artificial Sequence
  Description of Artificial Sequence: Synthetic polynucleotide
attctaatacgactcactatagggattctgtgctgaacgcgtcgttttagagctagaaatagcaagttaaaataaggctagtccgttatcaacttgaaaaagtggcaccgagtcggtgc

SEQ ID NO: 1522 - DNA, 23 bp, Artificial Sequence
  Description of Artificial Sequence: Synthetic oligonucleotide
gctcagcttctatgagaagcagg

SEQ ID NO: 1523 - DNA, 119 bp, Artificial Sequence
  Description of Artificial Sequence: Synthetic polynucleotide
attctaatacgactcactatagggctcagcttctatgagaagcgttttagagctagaaatagcaagttaaaataaggctagtccgttatcaacttgaaaaagtggcaccgagtcggtgc

SEQ ID NO: 1524 - DNA, 21 bp, Homo sapiens
ctcatagaagttgagcaactt

SEQ ID NO: 1525 - DNA, 21 bp, Artificial Sequence
  Description of Artificial Sequence: Synthetic oligonucleotide
ctcatagaagctgagcaactt

SEQ ID NO: 1526 - DNA, 23 bp, Artificial Sequence
  Description of Artificial Sequence: Synthetic oligonucleotide
cagcttctatgagaagcaggagg

SEQ ID NO: 1527 - DNA, 119 bp, Artificial Sequence
  Description of Artificial Sequence: Synthetic polynucleotide
attctaatacgactcactataggcagcttctatgagaagcagggttttagagctagaaatagcaagttaaaataaggctagtccgttatcaacttgaaaaagtggcaccgagtcggtgc

SEQ ID NO: 1528 - DNA, 23 bp, Artificial Sequence
  Description of Artificial Sequence: Synthetic oligonucleotide
agcttctatgagaagcaggaggg

SEQ ID NO: 1529 - DNA, 119 bp, Artificial Sequence
  Description of Artificial Sequence: Synthetic polynucleotide
attctaatacgactcactataggagcttctatgagaagcaggagttttagagctagaaatagcaagttaaaataaggctagtccgttatcaacttgaaaaagtggcaccgagtcggtgc

SEQ ID NO: 1530 - DNA, 23 bp, Artificial Sequence
  Description of Artificial Sequence: Synthetic oligonucleotide
taaaaaatattgttactctttgg

SEQ ID NO: 1531 - DNA, 119 bp, Artificial Sequence
  Description of Artificial Sequence: Synthetic polynucleotide
attctaatacgactcactataggtaaaaaatattgttactcttgttttagagctagaaatagcaagttaaaataaggctagtccgttatcaacttgaaaaagtggcaccgagtcggtgc

SEQ ID NO: 1532 - DNA, 23 bp, Artificial Sequence
  Description of Artificial Sequence: Synthetic oligonucleotide
atattgttactctttgggattgg

SEQ ID NO: 1533 - DNA, 119 bp, Artificial Sequence
  Description of Artificial Sequence: Synthetic polynucleotide
attctaatacgactcactataggatattgttactctttgggatgttttagagctagaaatagcaagttaaaataaggctagtccgttatcaacttgaaaaagtggcaccgagtcggtgc

SEQ ID NO: 1534 - DNA, 23 bp, Artificial Sequence
  Description of Artificial Sequence: Synthetic oligonucleotide
gttactctttgggattggaccgg

SEQ ID NO: 1535 - DNA, 119 bp, Artificial Sequence
  Description of Artificial Sequence: Synthetic polynucleotide
attctaatacgactcactatagggttactctttgggattggacgttttagagctagaaatagcaagttaaaataaggctagtccgttatcaacttgaaaaagtggcaccgagtcggtgc

SEQ ID NO: 1536 - DNA, 23 bp, Artificial Sequence
  Description of Artificial Sequence: Synthetic oligonucleotide
aaaaaatattgttactctttggg

SEQ ID NO: 1537 - DNA, 119 bp, Artificial Sequence
  Description of Artificial Sequence: Synthetic polynucleotide
attctaatacgactcactataggaaaaaatattgttactctttgttttagagctagaaatagcaagttaaaataaggctagtccgttatcaacttgaaaaagtggcaccgagtcggtgc

SEQ ID NO: 1538 - DNA, 23 bp, Artificial Sequence
  Description of Artificial Sequence: Synthetic oligonucleotide
gctgccatagttcatcccaacgg

SEQ ID NO: 1539 - DNA, 119 bp, Artificial Sequence
  Description of Artificial Sequence: Synthetic polynucleotide
attctaatacgactcactatagggctgccatagttcatcccaagttttagagctagaaatagcaagttaaaataaggctagtccgttatcaacttgaaaaagtggcaccgagtcggtgc

SEQ ID NO: 1540 - DNA, 21 bp, Homo sapiens
tgtagctgccgtagttcatcc

SEQ ID NO: 1541 - DNA, 21 bp, Artificial Sequence
  Description of Artificial Sequence: Synthetic oligonucleotide
tgtagctgccatagttcatcc

SEQ ID NO: 1542 - DNA, 23 bp, Artificial Sequence
  Description of Artificial Sequence: Synthetic oligonucleotide
gaactatggcagctacatggagg

SEQ ID NO: 1543 - DNA, 119 bp, Artificial Sequence
  Description of Artificial Sequence: Synthetic polynucleotide
attctaatacgactcactatagggaactatggcagctacatgggttttagagctagaaatagcaagttaaaataaggctagtccgttatcaacttgaaaaagtggcaccgagtcggtgc

SEQ ID NO: 1544 - DNA, 23 bp, Artificial Sequence
  Description of Artificial Sequence: Synthetic oligonucleotide
gacaccgttgggatgaactatgg

SEQ ID NO: 1545 - DNA, 119 bp, Artificial Sequence
  Description of Artificial Sequence: Synthetic polynucleotide
attctaatacgactcactatagggacaccgttgggatgaactagttttagagctagaaatagcaagttaaaataaggctagtccgttatcaacttgaaaaagtggcaccgagtcggtgc

SEQ ID NO: 1546 - DNA, 23 bp, Artificial Sequence
  Description of Artificial Sequence: Synthetic oligonucleotide
gatgaactatggcagctacatgg

SEQ ID NO: 1547 - DNA, 119 bp, Artificial Sequence
  Description of Artificial Sequence: Synthetic polynucleotide
attctaatacgactcactatagggatgaactatggcagctacagttttagagctagaaatagcaagttaaaataaggctagtccgttatcaacttgaaaaagtggcaccgagtcggtgc

SEQ ID NO: 1548 - DNA, 23 bp, Artificial Sequence
  Description of Artificial Sequence: Synthetic oligonucleotide
ctggccacactgcattcatcagg

SEQ ID NO: 1549 - DNA, 119 bp, Artificial Sequence
  Description of Artificial Sequence: Synthetic polynucleotide
attctaatacgactcactataggctggccacactgcattcatcgttttagagctagaaatagcaagttaaaataaggctagtccgttatcaacttgaaaaagtggcaccgagtcggtgc

SEQ ID NO: 1550 - DNA, 21 bp, Homo sapiens
cttcccgcctttggccacact

SEQ ID NO: 1551 - DNA, 21 bp, Artificial Sequence
  Description of Artificial Sequence: Synthetic oligonucleotide
cttcccgcctctggccacact

SEQ ID NO: 1552 - DNA, 23 bp, Artificial Sequence
  Description of Artificial Sequence: Synthetic oligonucleotide
gcccaccatcttcccgcctctgg

SEQ ID NO: 1553 - DNA, 119 bp, Artificial Sequence
  Description of Artificial Sequence: Synthetic polynucleotide
attctaatacgactcactatagggcccaccatcttcccgcctcgttttagagctagaaatagcaagttaaaataaggctagtccgttatcaacttgaaaaagtggcaccgagtcggtgc

SEQ ID NO: 1554 - DNA, 23 bp, Artificial Sequence
  Description of Artificial Sequence: Synthetic oligonucleotide
gatgaatgcagtgtggccagagg

SEQ ID NO: 1555 - DNA, 119 bp, Artificial Sequence
  Description of Artificial Sequence: Synthetic polynucleotide
attctaatacgactcactatagggatgaatgcagtgtggccaggttttagagctagaaatagcaagttaaaataaggctagtccgttatcaacttgaaaaagtggcaccgagtcggtgc

SEQ ID NO: 1556 - DNA, 23 bp, Artificial Sequence
  Description of Artificial Sequence: Synthetic oligonucleotide
tgtggccagaggcgggaagatgg

SEQ ID NO: 1557 - DNA, 119 bp, Artificial Sequence
  Description of Artificial Sequence: Synthetic polynucleotide
attctaatacgactcactataggtgtggccagaggcgggaagagttttagagctagaaatagcaagttaaaataaggctagtccgttatcaacttgaaaaagtggcaccgagtcggtgc

SEQ ID NO: 1558 - DNA, 23 bp, Artificial Sequence
  Description of Artificial Sequence: Synthetic oligonucleotide
ggccagaggcgggaagatggtgg

SEQ ID NO: 1559 - DNA, 119 bp, Artificial Sequence
  Description of Artificial Sequence: Synthetic polynucleotide
attctaatacgactcactataggggccagaggcgggaagatgggttttagagctagaaatagcaagttaaaataaggctagtccgttatcaacttgaaaaagtggcaccgagtcggtgc

SEQ ID NO: 1560 - DNA, 23 bp, Artificial Sequence
  Description of Artificial Sequence: Synthetic oligonucleotide
gaatgcagtgtggccagaggcgg

SEQ ID NO: 1561 - DNA, 119 bp, Artificial Sequence
  Description of Artificial Sequence: Synthetic polynucleotide
attctaatacgactcactatagggaatgcagtgtggccagagggttttagagctagaaatagcaagttaaaataaggctagtccgttatcaacttgaaaaagtggcaccgagtcggtgc

SEQ ID NO: 1562 - DNA, 23 bp, Artificial Sequence
  Description of Artificial Sequence: Synthetic oligonucleotide
aatgcagtgtggccagaggcggg

SEQ ID NO: 1563 - DNA, 119 bp, Artificial Sequence
  Description of Artificial Sequence: Synthetic polynucleotide
attctaatacgactcactataggaatgcagtgtggccagaggcgttttagagctagaaatagcaagttaaaataaggctagtccgttatcaacttgaaaaagtggcaccgagtcggtgc

SEQ ID NO: 1564 - DNA, 23 bp, Artificial Sequence
  Description of Artificial Sequence: Synthetic oligonucleotide
gccagaggcgggaagatggtggg

SEQ ID NO: 1565 - DNA, 119 bp, Artificial Sequence
  Description of Artificial Sequence: Synthetic polynucleotide
attctaatacgactcactatagggccagaggcgggaagatggtgttttagagctagaaatagcaagttaaaataaggctagtccgttatcaacttgaaaaagtggcaccgagtcggtgc

SEQ ID NO: 1566 - DNA, 23 bp, Artificial Sequence
  Description of Artificial Sequence: Synthetic oligonucleotide
gggaactctgggggaacctcagg

SEQ ID NO: 1567 - DNA, 119 bp, Artificial Sequence
  Description of Artificial Sequence: Synthetic polynucleotide
attctaatacgactcactatagggggaactctgggggaacctcgttttagagctagaaatagcaagttaaaataaggctagtccgttatcaacttgaaaaagtggcaccgagtcggtgc

SEQ ID NO: 1568 - DNA, 21 bp, Homo sapiens
tgggaactctggggggaacct

SEQ ID NO: 1569 - DNA, 20 bp, Artificial Sequence
  Description of Artificial Sequence: Synthetic oligonucleotide
tgggaactctgggggaacct

SEQ ID NO: 1570 - DNA, 23 bp, Artificial Sequence
  Description of Artificial Sequence: Synthetic oligonucleotide
tctaggaggtatgggaactctgg

SEQ ID NO: 1571 - DNA, 119 bp, Artificial Sequence
  Description of Artificial Sequence: Synthetic polynucleotide
attctaatacgactcactataggtctaggaggtatgggaactcgttttagagctagaaatagcaagttaaaataaggctagtccgttatcaacttgaaaaagtggcaccgagtcggtgc

SEQ ID NO: 1572 - DNA, 23 bp, Artificial Sequence
  Description of Artificial Sequence: Synthetic oligonucleotide
ctaggaggtatgggaactctggg

SEQ ID NO: 1573 - DNA, 119 bp, Artificial Sequence
  Description of Artificial Sequence: Synthetic polynucleotide
attctaatacgactcactataggctaggaggtatgggaactctgttttagagctagaaatagcaagttaaaataaggctagtccgttatcaacttgaaaaagtggcaccgagtcggtgc

SEQ ID NO: 1574 - DNA, 23 bp, Artificial Sequence
  Description of Artificial Sequence: Synthetic oligonucleotide
taggaggtatgggaactctgggg

SEQ ID NO: 1575 - DNA, 119 bp, Artificial Sequence
  Description of Artificial Sequence: Synthetic polynucleotide
attctaatacgactcactataggtaggaggtatgggaactctggttttagagctagaaatagcaagttaaaataaggctagtccgttatcaacttgaaaaagtggcaccgagtcggtgc

SEQ ID NO: 1576 - DNA, 23 bp, Artificial Sequence
  Description of Artificial Sequence: Synthetic oligonucleotide
aggaggtatgggaactctggggg

SEQ ID NO: 1577 - DNA, 119 bp, Artificial Sequence
  Description of Artificial Sequence: Synthetic polynucleotide
attctaatacgactcactataggaggaggtatgggaactctgggttttagagctagaaatagcaagttaaaataaggctagtccgttatcaacttgaaaaagtggcaccgagtcggtgc

SEQ ID NO: 1578 - DNA, 23 bp, Artificial Sequence
  Description of Artificial Sequence: Synthetic oligonucleotide
ctcggagacacgctattgagtgg

SEQ ID NO: 1579 - DNA, 119 bp, Artificial Sequence
  Description of Artificial Sequence: Synthetic polynucleotide
attctaatacgactcactataggctcggagacacgctattgaggttttagagctagaaatagcaagttaaaataaggctagtccgttatcaacttgaaaaagtggcaccgagtcggtgc

SEQ ID NO: 1580 - DNA, 23 bp, Artificial Sequence
  Description of Artificial Sequence: Synthetic oligonucleotide
tcggagacacgctattgagtggg

SEQ ID NO: 1581 - DNA, 119 bp, Artificial Sequence
  Description of Artificial Sequence: Synthetic polynucleotide
attctaatacgactcactataggtcggagacacgctattgagtgttttagagctagaaatagcaagttaaaataaggctagtccgttatcaacttgaaaaagtggcaccgagtcggtgc

SEQ ID NO: 1582 - DNA, 23 bp, Artificial Sequence
  Description of Artificial Sequence: Synthetic oligonucleotide
cggagacacgctattgagtgggg

SEQ ID NO: 1583 - DNA, 119 bp, Artificial Sequence
  Description of Artificial Sequence: Synthetic polynucleotide
attctaatacgactcactataggcggagacacgctattgagtggttttagagctagaaatagcaagttaaaataaggctagtccgttatcaacttgaaaaagtggcaccgagtcggtgc

SEQ ID NO: 1584 - DNA, 23 bp, Artificial Sequence
  Description of Artificial Sequence: Synthetic oligonucleotide
ggagacacgctattgagtggggg

SEQ ID NO: 1585 - DNA, 119 bp, Artificial Sequence
  Description of Artificial Sequence: Synthetic polynucleotide
attctaatacgactcactataggggagacacgctattgagtgggttttagagctagaaatagcaagttaaaataaggctagtccgttatcaacttgaaaaagtggcaccgagtcggtgc

SEQ ID NO: 1586 - DNA, 23 bp, Artificial Sequence
  Description of Artificial Sequence: Synthetic oligonucleotide
gagacacgctattgagtgggggg

SEQ ID NO: 1587 - DNA, 119 bp, Artificial Sequence
  Description of Artificial Sequence: Synthetic polynucleotide
attctaatacgactcactatagggagacacgctattgagtggggttttagagctagaaatagcaagttaaaataaggctagtccgttatcaacttgaaaaagtggcaccgagtcggtgc

SEQ ID NO: 1588 - DNA, 23 bp, Artificial Sequence
  Description of Artificial Sequence: Synthetic oligonucleotide
ctactttcagcctgatagtctgg

SEQ ID NO: 1589 - DNA, 119 bp, Artificial Sequence
  Description of Artificial Sequence: Synthetic polynucleotide
attctaatacgactcactataggctactttcagcctgatagtcgttttagagctagaaatagcaagttaaaataaggctagtccgttatcaacttgaaaaagtggcaccgagtcggtgc

SEQ ID NO: 1590 - DNA, 23 bp, Artificial Sequence
  Description of Artificial Sequence: Synthetic oligonucleotide
aggcttcatacatcttccctagg

SEQ ID NO: 1591 - DNA, 119 bp, Artificial Sequence
  Description of Artificial Sequence: Synthetic polynucleotide
attctaatacgactcactataggaggcttcatacatcttccctgttttagagctagaaatagcaagttaaaataaggctagtccgttatcaacttgaaaaagtggcaccgagtcggtgc

SEQ ID NO: 1592 - DNA, 23 bp, Artificial Sequence
  Description of Artificial Sequence: Synthetic oligonucleotide
acatcttccctaggaactcctgg

SEQ ID NO: 1593 - DNA, 119 bp, Artificial Sequence
  Description of Artificial Sequence: Synthetic polynucleotide
attctaatacgactcactataggacatcttccctaggaactccgttttagagctagaaatagcaagttaaaataaggctagtccgttatcaacttgaaaaagtggcaccgagtcggtgc

SEQ ID NO: 1594 - DNA, 23 bp, Artificial Sequence
  Description of Artificial Sequence: Synthetic oligonucleotide
gctcagttccaggagttcctagg

SEQ ID NO: 1595 - DNA, 119 bp, Artificial Sequence
  Description of Artificial Sequence: Synthetic polynucleotide
attctaatacgactcactatagggctcagttccaggagttcctgttttagagctagaaatagcaagttaaaataaggctagtccgttatcaacttgaaaaagtggcaccgagtcggtgc

SEQ ID NO: 1596 - DNA, 23 bp, Artificial Sequence
  Description of Artificial Sequence: Synthetic oligonucleotide
ctcagttccaggagttcctaggg

SEQ ID NO: 1597 - DNA, 119 bp, Artificial Sequence
  Description of Artificial Sequence: Synthetic polynucleotide
attctaatacgactcactataggctcagttccaggagttcctagttttagagctagaaatagcaagttaaaataaggctagtccgttatcaacttgaaaaagtggcaccgagtcggtgc

SEQ ID NO: 1598 - DNA, 23 bp, Artificial Sequence
  Description of Artificial Sequence: Synthetic oligonucleotide
aaagtccagcaacagcagcttgg

SEQ ID NO: 1599 - DNA, 119 bp, Artificial Sequence
  Description of Artificial Sequence: Synthetic polynucleotide
attctaatacgactcactataggaaagtccagcaacagcagctgttttagagctagaaatagcaagttaaaataaggctagtccgttatcaacttgaaaaagtggcaccgagtcggtgc

SEQ ID NO: 1600 - DNA, 21 bp, Homo sapiens
aagtccagcaccagcagcttg

SEQ ID NO: 1601 - DNA, 21 bp, Artificial Sequence
  Description of Artificial Sequence: Synthetic oligonucleotide
aagtccagcaacagcagcttg

SEQ ID NO: 1602 - DNA, 23 bp, Artificial Sequence
  Description of Artificial Sequence: Synthetic oligonucleotide
agaaaccaagctgctgttgctgg

SEQ ID NO: 1603 - DNA, 119 bp, Artificial Sequence
  Description of Artificial Sequence: Synthetic polynucleotide
attctaatacgactcactataggagaaaccaagctgctgttgcgttttagagctagaaatagcaagttaaaataaggctagtccgttatcaacttgaaaaagtggcaccgagtcggtgc

SEQ ID NO: 1604 - DNA, 23 bp, Artificial Sequence
  Description of Artificial Sequence: Synthetic oligonucleotide
gctgttgctggactttgatgtgg

SEQ ID NO: 1605 - DNA, 119 bp, Artificial Sequence
  Description of Artificial Sequence: Synthetic polynucleotide
attctaatacgactcactatagggctgttgctggactttgatggttttagagctagaaatagcaagttaaaataaggctagtccgttatcaacttgaaaaagtggcaccgagtcggtgc

SEQ ID NO: 1606 - DNA, 23 bp, Artificial Sequence
  Description of Artificial Sequence: Synthetic oligonucleotide
ggagtgggggagttgtgtgacgg

SEQ ID NO: 1607 - DNA, 119 bp, Artificial Sequence
  Description of Artificial Sequence: Synthetic polynucleotide
attctaatacgactcactataggggagtgggggagttgtgtgagttttagagctagaaatagcaagttaaaataaggctagtccgttatcaacttgaaaaagtggcaccgagtcggtgc

SEQ ID NO: 1608 - DNA, 23 bp, Artificial Sequence
  Description of Artificial Sequence: Synthetic oligonucleotide
agtggaagtatacccatataagg

SEQ ID NO: 1609 - DNA, 119 bp, Artificial Sequence
  Description of Artificial Sequence: Synthetic polynucleotide
attctaatacgactcactataggagtggaagtatacccatatagttttagagctagaaatagcaagttaaaataaggctagtccgttatcaacttgaaaaagtggcaccgagtcggtgc

SEQ ID NO: 1610 - DNA, 21 bp, Homo sapiens
gtggaagtatgcccatataag

SEQ ID NO: 1611 - DNA, 21 bp, Artificial Sequence
  Description of Artificial Sequence: Synthetic oligonucleotide
gtggaagtatacccatataag

SEQ ID NO: 1612 - DNA, 23 bp, Artificial Sequence
  Description of Artificial Sequence: Synthetic oligonucleotide
ccttcatggtgggcgacacttgg

SEQ ID NO: 1613 - DNA, 119 bp, Artificial Sequence
  Description of Artificial Sequence: Synthetic polynucleotide
attctaatacgactcactataggccttcatggtgggcgacactgttttagagctagaaatagcaagttaaaataaggctagtccgttatcaacttgaaaaagtggcaccgagtcggtgc

SEQ ID NO: 1614 - DNA, 21 bp, Homo sapiens
gggcgacactcggttcccctt

SEQ ID NO: 1615 - DNA, 21 bp, Artificial Sequence
  Description of Artificial Sequence: Synthetic oligonucleotide
gggcgacacttggttcccctt

SEQ ID NO: 1616 - DNA, 23 bp, Artificial Sequence
  Description of Artificial Sequence: Synthetic oligonucleotide
cgacacttggttccccttcttgg

SEQ ID NO: 1617 - DNA, 119 bp, Artificial Sequence
  Description of Artificial Sequence: Synthetic polynucleotide
attctaatacgactcactataggcgacacttggttccccttctgttttagagctagaaatagcaagttaaaataaggctagtccgttatcaacttgaaaaagtggcaccgagtcggtgc

SEQ ID NO: 1618 - DNA, 23 bp, Artificial Sequence
  Description of Artificial Sequence: Synthetic oligonucleotide
ccaagtgtcgcccaccatgaagg

SEQ ID NO: 1619 - DNA, 119 bp, Artificial Sequence
  Description of Artificial Sequence: Synthetic polynucleotide
attctaatacgactcactataggccaagtgtcgcccaccatgagttttagagctagaaatagcaagttaaaataaggctagtccgttatcaacttgaaaaagtggcaccgagtcggtgc

SEQ ID NO: 1620 - DNA, 23 bp, Artificial Sequence
  Description of Artificial Sequence: Synthetic oligonucleotide
ggtgccacgcctagagactccgg

SEQ ID NO: 1621 - DNA, 119 bp, Artificial Sequence
  Description of Artificial Sequence: Synthetic polynucleotide
attctaatacgactcactataggggtgccacgcctagagactcgttttagagctagaaatagcaagttaaaataaggctagtccgttatcaacttgaaaaagtggcaccgagtcggtgc

SEQ ID NO: 1622 - DNA, 21 bp, Homo sapiens
taggcgtggcgccctttatct

SEQ ID NO: 1623 - DNA, 21 bp, Artificial Sequence
  Description of Artificial Sequence: Synthetic oligonucleotide
taggcgtggcaccctttatct

SEQ ID NO: 1624 - DNA, 23 bp, Artificial Sequence
  Description of Artificial Sequence: Synthetic oligonucleotide
tttttcttcagtgtatgacaagg

SEQ ID NO: 1625 - DNA, 119 bp, Artificial Sequence
  Description of Artificial Sequence: Synthetic polynucleotide
attctaatacgactcactataggtttttcttcagtgtatgacagttttagagctagaaatagcaagttaaaataaggctagtccgttatcaacttgaaaaagtggcaccgagtcggtgc

SEQ ID NO: 1626 - DNA, 23 bp, Artificial Sequence
  Description of Artificial Sequence: Synthetic oligonucleotide
tcctcattcacatccccttgagg

SEQ ID NO: 1627 - DNA, 119 bp, Artificial Sequence
  Description of Artificial Sequence: Synthetic polynucleotide
attctaatacgactcactataggtcctcattcacatccccttggttttagagctagaaatagcaagttaaaataaggctagtccgttatcaacttgaaaaagtggcaccgagtcggtgc

SEQ ID NO: 1628 - DNA, 21 bp, Homo sapiens
gtcctcattcccatccccttg

SEQ ID NO: 1629 - DNA, 21 bp, Artificial Sequence
  Description of Artificial Sequence: Synthetic oligonucleotide
gtcctcattcacatccccttg

SEQ ID NO: 1630 - DNA, 23 bp, Artificial Sequence
  Description of Artificial Sequence: Synthetic oligonucleotide
ttcacatccccttgaggaagtgg

SEQ ID NO: 1631 - DNA, 119 bp, Artificial Sequence
  Description of Artificial Sequence: Synthetic polynucleotide
attctaatacgactcactataggttcacatccccttgaggaaggttttagagctagaaatagcaagttaaaataaggctagtccgttatcaacttgaaaaagtggcaccgagtcggtgc

SEQ ID NO: 1632 - DNA, 23 bp, Artificial Sequence
  Description of Artificial Sequence: Synthetic oligonucleotide
tcacatccccttgaggaagtggg

SEQ ID NO: 1633 - DNA, 119 bp, Artificial Sequence
  Description of Artificial Sequence: Synthetic polynucleotide
attctaatacgactcactataggtcacatccccttgaggaagtgttttagagctagaaatagcaagttaaaataaggctagtccgttatcaacttgaaaaagtggcaccgagtcggtgc

SEQ ID NO: 1634 - DNA, 23 bp, Artificial Sequence
  Description of Artificial Sequence: Synthetic oligonucleotide
cacatccccttgaggaagtgggg

SEQ ID NO: 1635 - DNA, 119 bp, Artificial Sequence
  Description of Artificial Sequence: Synthetic polynucleotide
attctaatacgactcactataggcacatccccttgaggaagtggttttagagctagaaatagcaagttaaaataaggctagtccgttatcaacttgaaaaagtggcaccgagtcggtgc

SEQ ID NO: 1636 - DNA, 23 bp, Artificial Sequence
  Description of Artificial Sequence: Synthetic oligonucleotide
tcctcaaggggatgtgaatgagg

SEQ ID NO: 1637 - DNA, 119 bp, Artificial Sequence
  Description of Artificial Sequence: Synthetic polynucleotide
attctaatacgactcactataggtcctcaaggggatgtgaatggttttagagctagaaatagcaagttaaaataaggctagtccgttatcaacttgaaaaagtggcaccgagtcggtgc

SEQ ID NO: 1638 - DNA, 23 bp, Artificial Sequence
  Description of Artificial Sequence: Synthetic oligonucleotide
gatgtgaatgaggacagtcctgg

SEQ ID NO: 1639 - DNA, 119 bp, Artificial Sequence
  Description of Artificial Sequence: Synthetic polynucleotide
attctaatacgactcactatagggatgtgaatgaggacagtccgttttagagctagaaatagcaagttaaaataaggctagtccgttatcaacttgaaaaagtggcaccgagtcggtgc

SEQ ID NO: 1640 - DNA, 23 bp, Artificial Sequence
  Description of Artificial Sequence: Synthetic oligonucleotide
cagcttctatgtgtcctctttgg

SEQ ID NO: 1641 - DNA, 119 bp, Artificial Sequence
  Description of Artificial Sequence: Synthetic polynucleotide
attctaatacgactcactataggcagcttctatgtgtcctcttgttttagagctagaaatagcaagttaaaataaggctagtccgttatcaacttgaaaaagtggcaccgagtcggtgc

SEQ ID NO: 1642 - DNA, 21 bp, Homo sapiens
agcagcttctgtgtgtcctct

SEQ ID NO: 1643 - DNA, 21 bp, Artificial Sequence
  Description of Artificial Sequence: Synthetic oligonucleotide
agcagcttctatgtgtcctct

SEQ ID NO: 1644 - DNA, 23 bp, Artificial Sequence
  Description of Artificial Sequence: Synthetic oligonucleotide
agcttctatgtgtcctctttggg

SEQ ID NO: 1645 - DNA, 119 bp, Artificial Sequence
  Description of Artificial Sequence: Synthetic polynucleotide
attctaatacgactcactataggagcttctatgtgtcctctttgttttagagctagaaatagcaagttaaaataaggctagtccgttatcaacttgaaaaagtggcaccgagtcggtgc

SEQ ID NO: 1646 - DNA, 23 bp, Artificial Sequence
  Description of Artificial Sequence: Synthetic oligonucleotide
atagaagctgctgagcatcctgg

SEQ ID NO: 1647 - DNA, 119 bp, Artificial Sequence
  Description of Artificial Sequence: Synthetic polynucleotide
attctaatacgactcactataggatagaagctgctgagcatccgttttagagctagaaatagcaagttaaaataaggctagtccgttatcaacttgaaaaagtggcaccgagtcggtgc

SEQ ID NO: 1648 - DNA, 23 bp, Artificial Sequence
  Description of Artificial Sequence: Synthetic oligonucleotide
tagaagctgctgagcatcctggg

SEQ ID NO: 1649 - DNA, 119 bp, Artificial Sequence
  Description of Artificial Sequence: Synthetic polynucleotide
attctaatacgactcactataggtagaagctgctgagcatcctgttttagagctagaaatagcaagttaaaataaggctagtccgttatcaacttgaaaaagtggcaccgagtcggtgc

SEQ ID NO: 1650 - DNA, 23 bp, Artificial Sequence
  Description of Artificial Sequence: Synthetic oligonucleotide
acttttatcttcttgaaagccgg

SEQ ID NO: 1651 - DNA, 119 bp, Artificial Sequence
  Description of Artificial Sequence: Synthetic polynucleotide
attctaatacgactcactataggacttttatcttcttgaaagcgttttagagctagaaatagcaagttaaaataaggctagtccgttatcaacttgaaaaagtggcaccgagtcggtgc

SEQ ID NO: 1652 - DNA, 23 bp, Artificial Sequence
  Description of Artificial Sequence: Synthetic oligonucleotide
tcagtggcaagaaaagacaccgg

SEQ ID NO: 1653 - DNA, 119 bp, Artificial Sequence
  Description of Artificial Sequence: Synthetic polynucleotide
attctaatacgactcactataggtcagtggcaagaaaagacacgttttagagctagaaatagcaagttaaaataaggctagtccgttatcaacttgaaaaagtggcaccgagtcggtgc

SEQ ID NO: 1654 - DNA, 23 bp, Artificial Sequence
  Description of Artificial Sequence: Synthetic oligonucleotide
tgcttttccatccttgtacctgg

SEQ ID NO: 1655 - DNA, 119 bp, Artificial Sequence
  Description of Artificial Sequence: Synthetic polynucleotide
attctaatacgactcactataggtgcttttccatccttgtaccgttttagagctagaaatagcaagttaaaataaggctagtccgttatcaacttgaaaaagtggcaccgagtcggtgc

SEQ ID NO: 1656 - DNA, 23 bp, Artificial Sequence
  Description of Artificial Sequence: Synthetic oligonucleotide
aaggatggaaaagcactgtccgg

SEQ ID NO: 1657 - DNA, 119 bp, Artificial Sequence
  Description of Artificial Sequence: Synthetic polynucleotide
attctaatacgactcactataggaaggatggaaaagcactgtcgttttagagctagaaatagcaagttaaaataaggctagtccgttatcaacttgaaaaagtggcaccgagtcggtgc

SEQ ID NO: 1658 - DNA, 23 bp, Artificial Sequence
  Description of Artificial Sequence: Synthetic oligonucleotide
aggatggaaaagcactgtccggg

SEQ ID NO: 1659 - DNA, 119 bp, Artificial Sequence
  Description of Artificial Sequence: Synthetic polynucleotide
attctaatacgactcactataggaggatggaaaagcactgtccgttttagagctagaaatagcaagttaaaataaggctagtccgttatcaacttgaaaaagtggcaccgagtcggtgc

SEQ ID NO: 1660 - DNA, 23 bp, Artificial Sequence
  Description of Artificial Sequence: Synthetic oligonucleotide
ggggtgctgcgcattcatcacgg

SEQ ID NO: 1661 - DNA, 119 bp, Artificial Sequence
  Description of Artificial Sequence: Synthetic polynucleotide
attctaatacgactcactataggggggtgctgcgcattcatcagttttagagctagaaatagcaagttaaaataaggctagtccgttatcaacttgaaaaagtggcaccgagtcggtgc

SEQ ID NO: 1662 - DNA, 21 bp, Homo sapiens
tgcgcattcagcacggccggg

SEQ ID NO: 1663 - DNA, 21 bp, Artificial Sequence
  Description of Artificial Sequence: Synthetic oligonucleotide
tgcgcattcatcacggccggg

SEQ ID NO: 1664 - DNA, 23 bp, Artificial Sequence
  Description of Artificial Sequence: Synthetic oligonucleotide
tgctgcgcattcatcacggccgg

SEQ ID NO: 1665 - DNA, 119 bp, Artificial Sequence
  Description of Artificial Sequence: Synthetic polynucleotide
attctaatacgactcactataggtgctgcgcattcatcacggcgttttagagctagaaatagcaagttaaaataaggctagtccgttatcaacttgaaaaagtggcaccgagtcggtgc

SEQ ID NO: 1666 - DNA, 23 bp, Artificial Sequence
  Description of Artificial Sequence: Synthetic oligonucleotide
gctgcgcattcatcacggccggg

SEQ ID NO: 1667 - DNA, 119 bp, Artificial Sequence
  Description of Artificial Sequence: Synthetic polynucleotide
attctaatacgactcactatagggctgcgcattcatcacggccgttttagagctagaaatagcaagttaaaataaggctagtccgttatcaacttgaaaaagtggcaccgagtcggtgc

SEQ ID NO: 1668 - DNA, 23 bp, Artificial Sequence
  Description of Artificial Sequence: Synthetic oligonucleotide
aagcttgtagtacagcccacagg

SEQ ID NO: 1669 - DNA, 119 bp, Artificial Sequence
  Description of Artificial Sequence: Synthetic polynucleotide
attctaatacgactcactataggaagcttgtagtacagcccacgttttagagctagaaatagcaagttaaaataaggctagtccgttatcaacttgaaaaagtggcaccgagtcggtgc

SEQ ID NO: 1670 - DNA, 21 bp, Homo sapiens
cctgtgggctctactacaagc

SEQ ID NO: 1671 - DNA, 21 bp, Artificial Sequence
  Description of Artificial Sequence: Synthetic oligonucleotide
cctgtgggctgtactacaagc

SEQ ID NO: 1672 - DNA, 23 bp, Artificial Sequence
  Description of Artificial Sequence: Synthetic oligonucleotide
agttgaacacggcgtctcagagg

SEQ ID NO: 1673 - DNA, 119 bp, Artificial Sequence
  Description of Artificial Sequence: Synthetic polynucleotide
attctaatacgactcactataggagttgaacacggcgtctcaggttttagagctagaaatagcaagttaaaataaggctagtccgttatcaacttgaaaaagtggcaccgagtcggtgc

SEQ ID NO: 1674 - DNA, 21 bp, Homo sapiens
ctgagacgccatgttcaactc

SEQ ID NO: 1675 - DNA, 21 bp, Artificial Sequence
  Description of Artificial Sequence: Synthetic oligonucleotide
ctgagacgccgtgttcaactc

SEQ ID NO: 1676 - DNA, 23 bp, Artificial Sequence
  Description of Artificial Sequence: Synthetic oligonucleotide
tgaacacggcgtctcagaggagg

SEQ ID NO: 1677 - DNA, 119 bp, Artificial Sequence
  Description of Artificial Sequence: Synthetic polynucleotide
attctaatacgactcactataggtgaacacggcgtctcagagggttttagagctagaaatagcaagttaaaataaggctagtccgttatcaacttgaaaaagtggcaccgagtcggtgc

SEQ ID NO: 1678 - DNA, 23 bp, Artificial Sequence
  Description of Artificial Sequence: Synthetic oligonucleotide
cggcgtctcagaggagggtgtgg

SEQ ID NO: 1679 - DNA, 119 bp, Artificial Sequence
  Description of Artificial Sequence: Synthetic polynucleotide
attctaatacgactcactataggcggcgtctcagaggagggtggttttagagctagaaatagcaagttaaaataaggctagtccgttatcaacttgaaaaagtggcaccgagtcggtgc

SEQ ID NO: 1680 - DNA, 23 bp, Artificial Sequence
  Description of Artificial Sequence: Synthetic oligonucleotide
tggggtcatcgagttgaacacgg

SEQ ID NO: 1681 - DNA, 119 bp, Artificial Sequence
  Description of Artificial Sequence: Synthetic polynucleotide
attctaatacgactcactataggtggggtcatcgagttgaacagttttagagctagaaatagcaagttaaaataaggctagtccgttatcaacttgaaaaagtggcaccgagtcggtgc

SEQ ID NO: 1682 - DNA, 23 bp, Artificial Sequence
  Description of Artificial Sequence: Synthetic oligonucleotide
gaacacggcgtctcagaggaggg

SEQ ID NO: 1683 - DNA, 119 bp, Artificial Sequence
  Description of Artificial Sequence: Synthetic polynucleotide
attctaatacgactcactatagggaacacggcgtctcagaggagttttagagctagaaatagcaagttaaaataaggctagtccgttatcaacttgaaaaagtggcaccgagtcggtgc

SEQ ID NO: 1684 - DNA, 23 bp, Artificial Sequence
  Description of Artificial Sequence: Synthetic oligonucleotide
agcccctggatgaagatctccgg

SEQ ID NO: 1685 - DNA, 119 bp, Artificial Sequence
  Description of Artificial Sequence: Synthetic polynucleotide
attctaatacgactcactataggagcccctggatgaagatctcgttttagagctagaaatagcaagttaaaataaggctagtccgttatcaacttgaaaaagtggcaccgagtcggtgc

SEQ ID NO: 1686 - DNA, 21 bp, Homo sapiens
cccctggatggagatctccgg

SEQ ID NO: 1687 - DNA, 21 bp, Artificial Sequence
  Description of Artificial Sequence: Synthetic oligonucleotide
cccctggatgaagatctccgg

SEQ ID NO: 1688 - DNA, 23 bp, Artificial Sequence
  Description of Artificial Sequence: Synthetic oligonucleotide
gggtccggagatcttcatccagg

SEQ ID NO: 1689 - DNA, 119 bp, Artificial Sequence
  Description of Artificial Sequence: Synthetic polynucleotide
attctaatacgactcactatagggggtccggagatcttcatccgttttagagctagaaatagcaagttaaaataaggctagtccgttatcaacttgaaaaagtggcaccgagtcggtgc

SEQ ID NO: 1690 - DNA, 23 bp, Artificial Sequence
  Description of Artificial Sequence: Synthetic oligonucleotide
ggtccggagatcttcatccaggg

SEQ ID NO: 1691 - DNA, 119 bp, Artificial Sequence
  Description of Artificial Sequence: Synthetic polynucleotide
attctaatacgactcactataggggtccggagatcttcatccagttttagagctagaaatagcaagttaaaataaggctagtccgttatcaacttgaaaaagtggcaccgagtcggtgc

SEQ ID NO: 1692 - DNA, 23 bp, Artificial Sequence
  Description of Artificial Sequence: Synthetic oligonucleotide
gtccggagatcttcatccagggg

SEQ ID NO: 1693 - DNA, 119 bp, Artificial Sequence
  Description of Artificial Sequence: Synthetic polynucleotide
attctaatacgactcactatagggtccggagatcttcatccaggttttagagctagaaatagcaagttaaaataaggctagtccgttatcaacttgaaaaagtggcaccgagtcggtgc

SEQ ID NO: 1694 - DNA, 23 bp, Artificial Sequence
  Description of Artificial Sequence: Synthetic oligonucleotide
ggtccccggagctcctcctgagg

SEQ ID NO: 1695 - DNA, 119 bp, Artificial Sequence
  Description of Artificial Sequence: Synthetic polynucleotide
attctaatacgactcactataggggtccccggagctcctcctggttttagagctagaaatagcaagttaaaataaggctagtccgttatcaacttgaaaaagtggcaccgagtcggtgc

SEQ ID NO: 1696 - DNA, 21 bp, Homo sapiens
gagctcctcccgaggagcccc

SEQ ID NO: 1697 - DNA, 21 bp, Artificial Sequence
  Description of Artificial Sequence: Synthetic oligonucleotide
gagctcctcctgaggagcccc

SEQ ID NO: 1698 - DNA, 23 bp, Artificial Sequence
  Description of Artificial Sequence: Synthetic oligonucleotide
ctgaggagccccaagccctcagg

SEQ ID NO: 1699 - DNA, 119 bp, Artificial Sequence
  Description of Artificial Sequence: Synthetic polynucleotide
attctaatacgactcactataggctgaggagccccaagccctcgttttagagctagaaatagcaagttaaaataaggctagtccgttatcaacttgaaaaagtggcaccgagtcggtgc

SEQ ID NO: 1700 - DNA, 23 bp, Artificial Sequence
  Description of Artificial Sequence: Synthetic oligonucleotide
ctgagggcttggggctcctcagg

SEQ ID NO: 1701 - DNA, 119 bp, Artificial Sequence
  Description of Artificial Sequence: Synthetic polynucleotide
attctaatacgactcactataggctgagggcttggggctcctcgttttagagctagaaatagcaagttaaaataaggctagtccgttatcaacttgaaaaagtggcaccgagtcggtgc

SEQ ID NO: 1702 - DNA, 23 bp, Artificial Sequence
  Description of Artificial Sequence: Synthetic oligonucleotide
agggcttggggctcctcaggagg

SEQ ID NO: 1703 - DNA, 119 bp, Artificial Sequence
  Description of Artificial Sequence: Synthetic polynucleotide
attctaatacgactcactataggagggcttggggctcctcagggttttagagctagaaatagcaagttaaaataaggctagtccgttatcaacttgaaaaagtggcaccgagtcggtgc

SEQ ID NO: 1704 - DNA, 23 bp, Artificial Sequence
  Description of Artificial Sequence: Synthetic oligonucleotide
gggctcctcaggaggagctccgg

SEQ ID NO: 1705 - DNA, 119 bp, Artificial Sequence
  Description of Artificial Sequence: Synthetic polynucleotide
attctaatacgactcactatagggggctcctcaggaggagctcgttttagagctagaaatagcaagttaaaataaggctagtccgttatcaacttgaaaaagtggcaccgagtcggtgc

SEQ ID NO: 1706 - DNA, 23 bp, Artificial Sequence
  Description of Artificial Sequence: Synthetic oligonucleotide
ggctcctcaggaggagctccggg

SEQ ID NO: 1707 - DNA, 119 bp, Artificial Sequence
  Description of Artificial Sequence: Synthetic polynucleotide
attctaatacgactcactataggggctcctcaggaggagctccgttttagagctagaaatagcaagttaaaataaggctagtccgttatcaacttgaaaaagtggcaccgagtcggtgc

SEQ ID NO: 1708 - DNA, 23 bp, Artificial Sequence
  Description of Artificial Sequence: Synthetic oligonucleotide
gctcctcaggaggagctccgggg

SEQ ID NO: 1709 - DNA, 119 bp, Artificial Sequence
  Description of Artificial Sequence: Synthetic polynucleotide
attctaatacgactcactatagggctcctcaggaggagctccggttttagagctagaaatagcaagttaaaataaggctagtccgttatcaacttgaaaaagtggcaccgagtcggtgc

SEQ ID NO: 1710 - DNA, 23 bp, Artificial Sequence
  Description of Artificial Sequence: Synthetic oligonucleotide
agcccagcttgggaggcttatgg

SEQ ID NO: 1711 - DNA, 119 bp, Artificial Sequence
  Description of Artificial Sequence: Synthetic polynucleotide
attctaatacgactcactataggagcccagcttgggaggcttagttttagagctagaaatagcaagttaaaataaggctagtccgttatcaacttgaaaaagtggcaccgagtcggtgc

SEQ ID NO: 1712 - DNA, 21 bp, Homo sapiens
tgggaggcttctggcctacac

SEQ ID NO: 1713 - DNA, 21 bp, Artificial Sequence
  Description of Artificial Sequence: Synthetic oligonucleotide
tgggaggcttatggcctacac

SEQ ID NO: 1714 - DNA, 23 bp, Artificial Sequence
  Description of Artificial Sequence: Synthetic oligonucleotide
gggaggcttatggcctacactgg

SEQ ID NO: 1715 - DNA, 119 bp, Artificial Sequence
  Description of Artificial Sequence: Synthetic polynucleotide
attctaatacgactcactatagggggaggcttatggcctacacgttttagagctagaaatagcaagttaaaataaggctagtccgttatcaacttgaaaaagtggcaccgagtcggtgc

SEQ ID NO: 1716 - DNA, 23 bp, Artificial Sequence
  Description of Artificial Sequence: Synthetic oligonucleotide
aggccataagcctcccaagctgg

SEQ ID NO: 1717 - DNA, 119 bp, Artificial Sequence
  Description of Artificial Sequence: Synthetic polynucleotide
attctaatacgactcactataggaggccataagcctcccaagcgttttagagctagaaatagcaagttaaaataaggctagtccgttatcaacttgaaaaagtggcaccgagtcggtgc

SEQ ID NO: 1718 - DNA, 23 bp, Artificial Sequence
  Description of Artificial Sequence: Synthetic oligonucleotide
ggccataagcctcccaagctggg

SEQ ID NO: 1719 - DNA, 119 bp, Artificial Sequence
  Description of Artificial Sequence: Synthetic polynucleotide
attctaatacgactcactataggggccataagcctcccaagctgttttagagctagaaatagcaagttaaaataaggctagtccgttatcaacttgaaaaagtggcaccgagtcggtgc

SEQ ID NO: 1720 - DNA, 23 bp, Artificial Sequence
  Description of Artificial Sequence: Synthetic oligonucleotide
atctcttatggaagatacctagg

SEQ ID NO: 1721 - DNA, 119 bp, Artificial Sequence
  Description of Artificial Sequence: Synthetic polynucleotide
attctaatacgactcactataggatctcttatggaagatacctgttttagagctagaaatagcaagttaaaataaggctagtccgttatcaacttgaaaaagtggcaccgagtcggtgc

SEQ ID NO: 1722 - DNA, 21 bp, Homo sapiens
gccatctcttctggaagatac

SEQ ID NO: 1723 - DNA, 21 bp, Artificial Sequence
  Description of Artificial Sequence: Synthetic oligonucleotide
gccatctcttatggaagatac

SEQ ID NO: 1724 - DNA, 23 bp, Artificial Sequence
  Description of Artificial Sequence: Synthetic oligonucleotide
tcagagtgggccatctcttatgg

SEQ ID NO: 1725 - DNA, 119 bp, Artificial Sequence
  Description of Artificial Sequence: Synthetic polynucleotide
attctaatacgactcactataggtcagagtgggccatctcttagttttagagctagaaatagcaagttaaaataaggctagtccgttatcaacttgaaaaagtggcaccgagtcggtgc

SEQ ID NO: 1726 - DNA, 23 bp, Artificial Sequence
  Description of Artificial Sequence: Synthetic oligonucleotide
tctcttatggaagatacctaggg

SEQ ID NO: 1727 - DNA, 119 bp, Artificial Sequence
  Description of Artificial Sequence: Synthetic polynucleotide
attctaatacgactcactataggtctcttatggaagatacctagttttagagctagaaatagcaagttaaaataaggctagtccgttatcaacttgaaaaagtggcaccgagtcggtgc

SEQ ID NO: 1728 - DNA, 23 bp, Artificial Sequence
  Description of Artificial Sequence: Synthetic oligonucleotide
taggtatcttccataagagatgg

SEQ ID NO: 1729 - DNA, 119 bp, Artificial Sequence
  Description of Artificial Sequence: Synthetic polynucleotide
attctaatacgactcactataggtaggtatcttccataagagagttttagagctagaaatagcaagttaaaataaggctagtccgttatcaacttgaaaaagtggcaccgagtcggtgc

SEQ ID NO: 1730 - DNA, 23 bp, Artificial Sequence
  Description of Artificial Sequence: Synthetic oligonucleotide
aggatttcaacgctgacctgagg

SEQ ID NO: 1731 - DNA, 119 bp, Artificial Sequence
  Description of Artificial Sequence: Synthetic polynucleotide
attctaatacgactcactataggaggatttcaacgctgacctggttttagagctagaaatagcaagttaaaataaggctagtccgttatcaacttgaaaaagtggcaccgagtcggtgc

SEQ ID NO: 1732 - DNA, 23 bp, Artificial Sequence
  Description of Artificial Sequence: Synthetic oligonucleotide
tcggctggccatcgggatttcgg

SEQ ID NO: 1733 - DNA, 119 bp, Artificial Sequence
  Description of Artificial Sequence: Synthetic polynucleotide
attctaatacgactcactataggtcggctggccatcgggatttgttttagagctagaaatagcaagttaaaataaggctagtccgttatcaacttgaaaaagtggcaccgagtcggtgc

SEQ ID NO: 1734 - DNA, 23 bp, Artificial Sequence
  Description of Artificial Sequence: Synthetic oligonucleotide
gaaatcccgatggccagccgagg

SEQ ID NO: 1735 - DNA, 119 bp, Artificial Sequence
  Description of Artificial Sequence: Synthetic polynucleotide
attctaatacgactcactatagggaaatcccgatggccagccggttttagagctagaaatagcaagttaaaataaggctagtccgttatcaacttgaaaaagtggcaccgagtcggtgc

SEQ ID NO: 1736 - DNA, 23 bp, Artificial Sequence
  Description of Artificial Sequence: Synthetic oligonucleotide
aattattgccgaaatcccgatgg

SEQ ID NO: 1737 - DNA, 119 bp, Artificial Sequence
  Description of Artificial Sequence: Synthetic polynucleotide
attctaatacgactcactataggaattattgccgaaatcccgagttttagagctagaaatagcaagttaaaataaggctagtccgttatcaacttgaaaaagtggcaccgagtcggtgc

SEQ ID NO: 1738 - DNA, 23 bp, Artificial Sequence
  Description of Artificial Sequence: Synthetic oligonucleotide
ccggatctcccgcagagccaagg

SEQ ID NO: 1739 - DNA, 119 bp, Artificial Sequence
  Description of Artificial Sequence: Synthetic polynucleotide
attctaatacgactcactataggccggatctcccgcagagccagttttagagctagaaatagcaagttaaaataaggctagtccgttatcaacttgaaaaagtggcaccgagtcggtgc

SEQ ID NO: 1740 - DNA, 21 bp, Homo sapiens
cgcagagccacggtgccgggc

SEQ ID NO: 1741 - DNA, 21 bp, Artificial Sequence
  Description of Artificial Sequence: Synthetic oligonucleotide
cgcagagccaaggtgccgggc

SEQ ID NO: 1742 - DNA, 23 bp, Artificial Sequence
  Description of Artificial Sequence: Synthetic oligonucleotide
ctcccgcagagccaaggtgccgg

SEQ ID NO: 1743 - DNA, 119 bp, Artificial Sequence
  Description of Artificial Sequence: Synthetic polynucleotide
attctaatacgactcactataggctcccgcagagccaaggtgcgttttagagctagaaatagcaagttaaaataaggctagtccgttatcaacttgaaaaagtggcaccgagtcggtgc

SEQ ID NO: 1744 - DNA, 23 bp, Artificial Sequence
  Description of Artificial Sequence: Synthetic oligonucleotide
gcagagccaaggtgccgggccgg

SEQ ID NO: 1745 - DNA, 119 bp, Artificial Sequence
  Description of Artificial Sequence: Synthetic polynucleotide
attctaatacgactcactatagggcagagccaaggtgccgggcgttttagagctagaaatagcaagttaaaataaggctagtccgttatcaacttgaaaaagtggcaccgagtcggtgc

SEQ ID NO: 1746 - DNA, 23 bp, Artificial Sequence
  Description of Artificial Sequence: Synthetic oligonucleotide
ccaaggtgccgggccggtagcgg

SEQ ID NO: 1747 - DNA, 119 bp, Artificial Sequence
  Description of Artificial Sequence: Synthetic polynucleotide
attctaatacgactcactataggccaaggtgccgggccggtaggttttagagctagaaatagcaagttaaaataaggctagtccgttatcaacttgaaaaagtggcaccgagtcggtgc

SEQ ID NO: 1748 - DNA, 23 bp, Artificial Sequence
  Description of Artificial Sequence: Synthetic oligonucleotide
tcccgcagagccaaggtgccggg

SEQ ID NO: 1749 - DNA, 119 bp, Artificial Sequence
  Description of Artificial Sequence: Synthetic polynucleotide
attctaatacgactcactataggtcccgcagagccaaggtgccgttttagagctagaaatagcaagttaaaataaggctagtccgttatcaacttgaaaaagtggcaccgagtcggtgc

SEQ ID NO: 1750 - DNA, 23 bp, Artificial Sequence
  Description of Artificial Sequence: Synthetic oligonucleotide
ccgctaccggcccggcaccttgg

SEQ ID NO: 1751 - DNA, 119 bp, Artificial Sequence
  Description of Artificial Sequence: Synthetic polynucleotide
attctaatacgactcactataggccgctaccggcccggcacctgttttagagctagaaatagcaagttaaaataaggctagtccgttatcaacttgaaaaagtggcaccgagtcggtgc

SEQ ID NO: 1752 - DNA, 23 bp, Artificial Sequence
  Description of Artificial Sequence: Synthetic oligonucleotide
ggcccggcaccttggctctgcgg

SEQ ID NO: 1753 - DNA, 119 bp, Artificial Sequence
  Description of Artificial Sequence: Synthetic polynucleotide
attctaatacgactcactataggggcccggcaccttggctctggttttagagctagaaatagcaagttaaaataaggctagtccgttatcaacttgaaaaagtggcaccgagtcggtgc

SEQ ID NO: 1754 - DNA, 23 bp, Artificial Sequence
  Description of Artificial Sequence: Synthetic oligonucleotide
ccttggctctgcgggagatccgg

SEQ ID NO: 1755 - DNA, 119 bp, Artificial Sequence
  Description of Artificial Sequence: Synthetic polynucleotide
attctaatacgactcactataggccttggctctgcgggagatcgttttagagctagaaatagcaagttaaaataaggctagtccgttatcaacttgaaaaagtggcaccgagtcggtgc

SEQ ID NO: 1756 - DNA, 23 bp, Artificial Sequence
  Description of Artificial Sequence: Synthetic oligonucleotide
gcccggcaccttggctctgcggg

SEQ ID NO: 1757 - DNA, 119 bp, Artificial Sequence
  Description of Artificial Sequence: Synthetic polynucleotide
attctaatacgactcactatagggcccggcaccttggctctgcgttttagagctagaaatagcaagttaaaataaggctagtccgttatcaacttgaaaaagtggcaccgagtcggtgc

SEQ ID NO: 1758 - DNA, 23 bp, Artificial Sequence
  Description of Artificial Sequence: Synthetic oligonucleotide
taattctgtggtacctcagaagg

SEQ ID NO: 1759 - DNA, 119 bp, Artificial Sequence
  Description of Artificial Sequence: Synthetic polynucleotide
attctaatacgactcactataggtaattctgtggtacctcagagttttagagctagaaatagcaagttaaaataaggctagtccgttatcaacttgaaaaagtggcaccgagtcggtgc

SEQ ID NO: 1760 - DNA, 21 bp, Homo sapiens
cataatacatcaattctgtgg

SEQ ID NO: 1761 - DNA, 21 bp, Artificial Sequence
  Description of Artificial Sequence: Synthetic oligonucleotide
cataatacattaattctgtgg

SEQ ID NO: 1762 - DNA, 23 bp, Artificial Sequence
  Description of Artificial Sequence: Synthetic oligonucleotide
agcataatacattaattctgtgg

SEQ ID NO: 1763 - DNA, 119 bp, Artificial Sequence
  Description of Artificial Sequence: Synthetic polynucleotide
attctaatacgactcactataggagcataatacattaattctggttttagagctagaaatagcaagttaaaataaggctagtccgttatcaacttgaaaaagtggcaccgagtcggtgc

SEQ ID NO: 1764 - DNA, 23 bp, Artificial Sequence
  Description of Artificial Sequence: Synthetic oligonucleotide
ggccattaaaacagtgaacaagg

SEQ ID NO: 1765 - DNA, 119 bp, Artificial Sequence
  Description of Artificial Sequence: Synthetic polynucleotide
attctaatacgactcactataggggccattaaaacagtgaacagttttagagctagaaatagcaagttaaaataaggctagtccgttatcaacttgaaaaagtggcaccgagtcggtgc

SEQ ID NO: 1766 - DNA, 21 bp, Homo sapiens
aacagtgaacgaggccgcaag

SEQ ID NO: 1767 - DNA, 21 bp, Artificial Sequence
  Description of Artificial Sequence: Synthetic oligonucleotide
aacagtgaacaaggccgcaag

SEQ ID NO: 1768 - DNA, 23 bp, Artificial Sequence
  Description of Artificial Sequence: Synthetic oligonucleotide
ggccttgttcactgttttaatgg

SEQ ID NO: 1769 - DNA, 119 bp, Artificial Sequence
  Description of Artificial Sequence: Synthetic polynucleotide
attctaatacgactcactataggggccttgttcactgttttaagttttagagctagaaatagcaagttaaaataaggctagtccgttatcaacttgaaaaagtggcaccgagtcggtgc

SEQ ID NO: 1770 - DNA, 23 bp, Artificial Sequence
  Description of Artificial Sequence: Synthetic oligonucleotide
caggacctcctgcgtagccttgg

SEQ ID NO: 1771 - DNA, 119 bp, Artificial Sequence
  Description of Artificial Sequence: Synthetic polynucleotide
attctaatacgactcactataggcaggacctcctgcgtagcctgttttagagctagaaatagcaagttaaaataaggctagtccgttatcaacttgaaaaagtggcaccgagtcggtgc

SEQ ID NO: 1772 - DNA, 23 bp, Artificial Sequence
  Description of Artificial Sequence: Synthetic oligonucleotide
aggacctcctgcgtagccttggg

SEQ ID NO: 1773 - DNA, 119 bp, Artificial Sequence
  Description of Artificial Sequence: Synthetic polynucleotide
attctaatacgactcactataggaggacctcctgcgtagccttgttttagagctagaaatagcaagttaaaataaggctagtccgttatcaacttgaaaaagtggcaccgagtcggtgc

SEQ ID NO: 1774 - DNA, 23 bp, Artificial Sequence
  Description of Artificial Sequence: Synthetic oligonucleotide
ttgtagtcccaaggctacgcagg

SEQ ID NO: 1775 - DNA, 119 bp, Artificial Sequence
  Description of Artificial Sequence: Synthetic polynucleotide
attctaatacgactcactataggttgtagtcccaaggctacgcgttttagagctagaaatagcaagttaaaataaggctagtccgttatcaacttgaaaaagtggcaccgagtcggtgc

SEQ ID NO: 1776 - DNA, 23 bp, Artificial Sequence
  Description of Artificial Sequence: Synthetic oligonucleotide
tagtcccaaggctacgcaggagg

SEQ ID NO: 1777 - DNA, 119 bp, Artificial Sequence
  Description of Artificial Sequence: Synthetic polynucleotide
attctaatacgactcactataggtagtcccaaggctacgcagggttttagagctagaaatagcaagttaaaataaggctagtccgttatcaacttgaaaaagtggcaccgagtcggtgc

SEQ ID NO: 1778 - DNA, 23 bp, Artificial Sequence
  Description of Artificial Sequence: Synthetic oligonucleotide
caaggctacgcaggaggtcctgg

SEQ ID NO: 1779 - DNA, 119 bp, Artificial Sequence
  Description of Artificial Sequence: Synthetic polynucleotide
attctaatacgactcactataggcaaggctacgcaggaggtccgttttagagctagaaatagcaagttaaaataaggctagtccgttatcaacttgaaaaagtggcaccgagtcggtgc

SEQ ID NO: 1780 - DNA, 23 bp, Artificial Sequence
  Description of Artificial Sequence: Synthetic oligonucleotide
tctcaactcccctgatgtcctgg

SEQ ID NO: 1781 - DNA, 119 bp, Artificial Sequence
  Description of Artificial Sequence: Synthetic polynucleotide
attctaatacgactcactataggtctcaactcccctgatgtccgttttagagctagaaatagcaagttaaaataaggctagtccgttatcaacttgaaaaagtggcaccgagtcggtgc

SEQ ID NO: 1782 - DNA, 21 bp, Homo sapiens
agagcccgacgctcaactccc

SEQ ID NO: 1783 - DNA, 21 bp, Artificial Sequence
  Description of Artificial Sequence: Synthetic oligonucleotide
agagcccgactctcaactccc

SEQ ID NO: 1784 - DNA, 23 bp, Artificial Sequence
  Description of Artificial Sequence: Synthetic oligonucleotide
acatcaggggagttgagagtcgg

SEQ ID NO: 1785 - DNA, 119 bp, Artificial Sequence
  Description of Artificial Sequence: Synthetic polynucleotide
attctaatacgactcactataggacatcaggggagttgagagtgttttagagctagaaatagcaagttaaaataaggctagtccgttatcaacttgaaaaagtggcaccgagtcggtgc

SEQ ID NO: 1786 - DNA, 23 bp, Artificial Sequence
  Description of Artificial Sequence: Synthetic oligonucleotide
catcaggggagttgagagtcggg

SEQ ID NO: 1787 - DNA, 119 bp, Artificial Sequence
  Description of Artificial Sequence: Synthetic polynucleotide
attctaatacgactcactataggcatcaggggagttgagagtcgttttagagctagaaatagcaagttaaaataaggctagtccgttatcaacttgaaaaagtggcaccgagtcggtgc

SEQ ID NO: 1788 - DNA, 23 bp, Artificial Sequence
  Description of Artificial Sequence: Synthetic oligonucleotide
tgaaaatgcgaaatatctgaagg

SEQ ID NO: 1789 - DNA, 119 bp, Artificial Sequence
  Description of Artificial Sequence: Synthetic polynucleotide
attctaatacgactcactataggtgaaaatgcgaaatatctgagttttagagctagaaatagcaagttaaaataaggctagtccgttatcaacttgaaaaagtggcaccgagtcggtgc

SEQ ID NO: 1790 - DNA, 23 bp, Artificial Sequence
  Description of Artificial Sequence: Synthetic oligonucleotide
gaaaatgcgaaatatctgaaggg

SEQ ID NO: 1791 - DNA, 119 bp, Artificial Sequence
  Description of Artificial Sequence: Synthetic polynucleotide
attctaatacgactcactatagggaaaatgcgaaatatctgaagttttagagctagaaatagcaagttaaaataaggctagtccgttatcaacttgaaaaagtggcaccgagtcggtgc

SEQ ID NO: 1792 - DNA, 23 bp, Artificial Sequence
  Description of Artificial Sequence: Synthetic oligonucleotide
aaaatgcgaaatatctgaagggg

SEQ ID NO: 1793 - DNA, 119 bp, Artificial Sequence
  Description of Artificial Sequence: Synthetic polynucleotide
attctaatacgactcactataggaaaatgcgaaatatctgaaggttttagagctagaaatagcaagttaaaataaggctagtccgttatcaacttgaaaaagtggcaccgagtcggtgc

SEQ ID NO: 1794 - DNA, 23 bp, Artificial Sequence
  Description of Artificial Sequence: Synthetic oligonucleotide
ttcagatatttcgcattttcagg

SEQ ID NO: 1795 - DNA, 119 bp, Artificial Sequence
  Description of Artificial Sequence: Synthetic polynucleotide
attctaatacgactcactataggttcagatatttcgcattttcgttttagagctagaaatagcaagttaaaataaggctagtccgttatcaacttgaaaaagtggcaccgagtcggtgc

SEQ ID NO: 1796 - DNA, 23 bp, Artificial Sequence
  Description of Artificial Sequence: Synthetic oligonucleotide
ttgctcctcttccgggtctatgg

SEQ ID NO: 1797 - DNA, 119 bp, Artificial Sequence
  Description of Artificial Sequence: Synthetic polynucleotide
attctaatacgactcactataggttgctcctcttccgggtctagttttagagctagaaatagcaagttaaaataaggctagtccgttatcaacttgaaaaagtggcaccgagtcggtgc

SEQ ID NO: 1798 - DNA, 21 bp, Homo sapiens
cccggaagagcagcaagtaat

SEQ ID NO: 1799 - DNA, 21 bp, Artificial Sequence
  Description of Artificial Sequence: Synthetic oligonucleotide
cccggaagaggagcaagtaat

SEQ ID NO: 1800 - DNA, 23 bp, Artificial Sequence
  Description of Artificial Sequence: Synthetic oligonucleotide
ctgattacttgctcctcttccgg

SEQ ID NO: 1801 - DNA, 119 bp, Artificial Sequence
  Description of Artificial Sequence: Synthetic polynucleotide
attctaatacgactcactataggctgattacttgctcctcttcgttttagagctagaaatagcaagttaaaataaggctagtccgttatcaacttgaaaaagtggcaccgagtcggtgc

SEQ ID NO: 1802 - DNA, 23 bp, Artificial Sequence
  Description of Artificial Sequence: Synthetic oligonucleotide
tgattacttgctcctcttccggg

SEQ ID NO: 1803 - DNA, 119 bp, Artificial Sequence
  Description of Artificial Sequence: Synthetic polynucleotide
attctaatacgactcactataggtgattacttgctcctcttccgttttagagctagaaatagcaagttaaaataaggctagtccgttatcaacttgaaaaagtggcaccgagtcggtgc

SEQ ID NO: 1804 - DNA, 23 bp, Artificial Sequence
  Description of Artificial Sequence: Synthetic oligonucleotide
tgctcctcttccgggtctatggg

SEQ ID NO: 1805 - DNA, 119 bp, Artificial Sequence
  Description of Artificial Sequence: Synthetic polynucleotide
attctaatacgactcactataggtgctcctcttccgggtctatgttttagagctagaaatagcaagttaaaataaggctagtccgttatcaacttgaaaaagtggcaccgagtcggtgc

SEQ ID NO: 1806 - DNA, 23 bp, Artificial Sequence
  Description of Artificial Sequence: Synthetic oligonucleotide
ggacacgctggcgggactcatgg

SEQ ID NO: 1807 - DNA, 119 bp, Artificial Sequence
  Description of Artificial Sequence: Synthetic polynucleotide
attctaatacgactcactataggggacacgctggcgggactcagttttagagctagaaatagcaagttaaaataaggctagtccgttatcaacttgaaaaagtggcaccgagtcggtgc

SEQ ID NO: 1808 - DNA, 21 bp, Homo sapiens
cgctggcggggctcatgggca

SEQ ID NO: 1809 - DNA, 21 bp, Artificial Sequence
  Description of Artificial Sequence: Synthetic oligonucleotide
cgctggcgggactcatgggca

SEQ ID NO: 1810 - DNA, 23 bp, Artificial Sequence
  Description of Artificial Sequence: Synthetic oligonucleotide
gacacgctggcgggactcatggg

SEQ ID NO: 1811 - DNA, 119 bp, Artificial Sequence
  Description of Artificial Sequence: Synthetic polynucleotide
attctaatacgactcactatagggacacgctggcgggactcatgttttagagctagaaatagcaagttaaaataaggctagtccgttatcaacttgaaaaagtggcaccgagtcggtgc

SEQ ID NO: 1812 - DNA, 23 bp, Artificial Sequence
  Description of Artificial Sequence: Synthetic oligonucleotide
actggagtatctgtttgcttagg

SEQ ID NO: 1813 - DNA, 119 bp, Artificial Sequence
  Description of Artificial Sequence: Synthetic polynucleotide
attctaatacgactcactataggactggagtatctgtttgcttgttttagagctagaaatagcaagttaaaataaggctagtccgttatcaacttgaaaaagtggcaccgagtcggtgc

SEQ ID NO: 1814 - DNA, 23 bp, Artificial Sequence
  Description of Artificial Sequence: Synthetic oligonucleotide
gagtatctgtttgcttaggtagg

SEQ ID NO: 1815 - DNA, 119 bp, Artificial Sequence
  Description of Artificial Sequence: Synthetic polynucleotide
attctaatacgactcactatagggagtatctgtttgcttaggtgttttagagctagaaatagcaagttaaaataaggctagtccgttatcaacttgaaaaagtggcaccgagtcggtgc

SEQ ID NO: 1816 - DNA, 23 bp, Artificial Sequence
  Description of Artificial Sequence: Synthetic oligonucleotide
taggtaggaagtttgggcccagg

SEQ ID NO: 1817 - DNA, 119 bp, Artificial Sequence
  Description of Artificial Sequence: Synthetic polynucleotide
attctaatacgactcactataggtaggtaggaagtttgggcccgttttagagctagaaatagcaagttaaaataaggctagtccgttatcaacttgaaaaagtggcaccgagtcggtgc

SEQ ID NO: 1818 - DNA, 23 bp, Artificial Sequence
  Description of Artificial Sequence: Synthetic oligonucleotide
gtttgcttaggtaggaagtttgg

SEQ ID NO: 1819 - DNA, 119 bp, Artificial Sequence
  Description of Artificial Sequence: Synthetic polynucleotide
attctaatacgactcactatagggtttgcttaggtaggaagttgttttagagctagaaatagcaagttaaaataaggctagtccgttatcaacttgaaaaagtggcaccgagtcggtgc

SEQ ID NO: 1820 - DNA, 23 bp, Artificial Sequence
  Description of Artificial Sequence: Synthetic oligonucleotide
tttgcttaggtaggaagtttggg

SEQ ID NO: 1821 - DNA, 119 bp, Artificial Sequence
  Description of Artificial Sequence: Synthetic polynucleotide
attctaatacgactcactataggtttgcttaggtaggaagtttgttttagagctagaaatagcaagttaaaataaggctagtccgttatcaacttgaaaaagtggcaccgagtcggtgc

SEQ ID NO: 1822 - DNA, 23 bp, Artificial Sequence
  Description of Artificial Sequence: Synthetic oligonucleotide
tccatatagatgagtcagccagg

SEQ ID NO: 1823 - DNA, 119 bp, Artificial Sequence
  Description of Artificial Sequence: Synthetic polynucleotide
attctaatacgactcactataggtccatatagatgagtcagccgttttagagctagaaatagcaagttaaaataaggctagtccgttatcaacttgaaaaagtggcaccgagtcggtgc

SEQ ID NO: 1824 - DNA, 21 bp, Homo sapiens
agatgagtcaaccaggcataa

SEQ ID NO: 1825 - DNA, 21 bp, Artificial Sequence
  Description of Artificial Sequence: Synthetic oligonucleotide
agatgagtcagccaggcataa

SEQ ID NO: 1826 - DNA, 23 bp, Artificial Sequence
  Description of Artificial Sequence: Synthetic oligonucleotide
gcctggctgactcatctatatgg

SEQ ID NO: 1827 - DNA, 119 bp, Artificial Sequence
  Description of Artificial Sequence: Synthetic polynucleotide
attctaatacgactcactatagggcctggctgactcatctatagttttagagctagaaatagcaagttaaaataaggctagtccgttatcaacttgaaaaagtggcaccgagtcggtgc

SEQ ID NO: 1828 - DNA, 23 bp, Artificial Sequence
  Description of Artificial Sequence: Synthetic oligonucleotide
agctaagtgtctgcgccttccgg

SEQ ID NO: 1829 - DNA, 119 bp, Artificial Sequence
  Description of Artificial Sequence: Synthetic polynucleotide
attctaatacgactcactataggagctaagtgtctgcgccttcgttttagagctagaaatagcaagttaaaataaggctagtccgttatcaacttgaaaaagtggcaccgagtcggtgc

SEQ ID NO: 1830 - DNA, 21 bp, Homo sapiens
gtctgcgcctcccggagacac

SEQ ID NO: 1831 - DNA, 21 bp, Artificial Sequence
  Description of Artificial Sequence: Synthetic oligonucleotide
gtctgcgccttccggagacac

SEQ ID NO: 1832 - DNA, 23 bp, Artificial Sequence
  Description of Artificial Sequence: Synthetic oligonucleotide
ctgcgccttccggagacactcgg

SEQ ID NO: 1833 - DNA, 119 bp, Artificial Sequence
  Description of Artificial Sequence: Synthetic polynucleotide
attctaatacgactcactataggctgcgccttccggagacactgttttagagctagaaatagcaagttaaaataaggctagtccgttatcaacttgaaaaagtggcaccgagtcggtgc

SEQ ID NO: 1834 - DNA, 23 bp, Artificial Sequence
  Description of Artificial Sequence: Synthetic oligonucleotide
tgcgccttccggagacactcggg

SEQ ID NO: 1835 - DNA, 119 bp, Artificial Sequence
  Description of Artificial Sequence: Synthetic polynucleotide
attctaatacgactcactataggtgcgccttccggagacactcgttttagagctagaaatagcaagttaaaataaggctagtccgttatcaacttgaaaaagtggcaccgagtcggtgc

SEQ ID NO: 1836 - DNA, 23 bp, Artificial Sequence
  Description of Artificial Sequence: Synthetic oligonucleotide
gcgccttccggagacactcgggg

SEQ ID NO: 1837 - DNA, 119 bp, Artificial Sequence
  Description of Artificial Sequence: Synthetic polynucleotide
attctaatacgactcactatagggcgccttccggagacactcggttttagagctagaaatagcaagttaaaataaggctagtccgttatcaacttgaaaaagtggcaccgagtcggtgc

SEQ ID NO: 1838 - DNA, 23 bp, Artificial Sequence
  Description of Artificial Sequence: Synthetic oligonucleotide
cgccttccggagacactcggggg

SEQ ID NO: 1839 - DNA, 119 bp, Artificial Sequence
  Description of Artificial Sequence: Synthetic polynucleotide
attctaatacgactcactataggcgccttccggagacactcgggttttagagctagaaatagcaagttaaaataaggctagtccgttatcaacttgaaaaagtggcaccgagtcggtgc

SEQ ID NO: 1840 - DNA, 23 bp, Artificial Sequence
  Description of Artificial Sequence: Synthetic oligonucleotide
ggcccccgagtgtctccggaagg

SEQ ID NO: 1841 - DNA, 119 bp, Artificial Sequence
  Description of Artificial Sequence: Synthetic polynucleotide
attctaatacgactcactataggggcccccgagtgtctccggagttttagagctagaaatagcaagttaaaataaggctagtccgttatcaacttgaaaaagtggcaccgagtcggtgc

SEQ ID NO: 1842 - DNA, 23 bp, Artificial Sequence
  Description of Artificial Sequence: Synthetic oligonucleotide
gaaggcgcagacacttagcttgg

SEQ ID NO: 1843 - DNA, 119 bp, Artificial Sequence
  Description of Artificial Sequence: Synthetic polynucleotide
attctaatacgactcactatagggaaggcgcagacacttagctgttttagagctagaaatagcaagttaaaataaggctagtccgttatcaacttgaaaaagtggcaccgagtcggtgc

SEQ ID NO: 1844 - DNA, 23 bp, Artificial Sequence
  Description of Artificial Sequence: Synthetic oligonucleotide
cgacctggacacatacagtgagg

SEQ ID NO: 1845 - DNA, 119 bp, Artificial Sequence
  Description of Artificial Sequence: Synthetic polynucleotide
attctaatacgactcactataggcgacctggacacatacagtggttttagagctagaaatagcaagttaaaataaggctagtccgttatcaacttgaaaaagtggcaccgagtcggtgc

SEQ ID NO: 1846 - DNA, 23 bp, Artificial Sequence
  Description of Artificial Sequence: Synthetic oligonucleotide
cctggacacatacagtgaggagg

SEQ ID NO: 1847 - DNA, 119 bp, Artificial Sequence
  Description of Artificial Sequence: Synthetic polynucleotide
attctaatacgactcactataggcctggacacatacagtgagggttttagagctagaaatagcaagttaaaataaggctagtccgttatcaacttgaaaaagtggcaccgagtcggtgc

SEQ ID NO: 1848 - DNA, 23 bp, Artificial Sequence
  Description of Artificial Sequence: Synthetic oligonucleotide
cctcctcactgtatgtgtccagg

SEQ ID NO: 1849 - DNA, 119 bp, Artificial Sequence
  Description of Artificial Sequence: Synthetic polynucleotide
attctaatacgactcactataggcctcctcactgtatgtgtccgttttagagctagaaatagcaagttaaaataaggctagtccgttatcaacttgaaaaagtggcaccgagtcggtgc

SEQ ID NO: 1850 - DNA, 23 bp, Artificial Sequence
  Description of Artificial Sequence: Synthetic oligonucleotide
ctcactgtatgtgtccaggtcgg

SEQ ID NO: 1851 - DNA, 119 bp, Artificial Sequence
  Description of Artificial Sequence: Synthetic polynucleotide
attctaatacgactcactataggctcactgtatgtgtccaggtgttttagagctagaaatagcaagttaaaataaggctagtccgttatcaacttgaaaaagtggcaccgagtcggtgc

SEQ ID NO: 1852 - DNA, 23 bp, Artificial Sequence
  Description of Artificial Sequence: Synthetic oligonucleotide
gaaatgtcatccgactcagctgg

SEQ ID NO: 1853 - DNA, 119 bp, Artificial Sequence
  Description of Artificial Sequence: Synthetic polynucleotide
attctaatacgactcactatagggaaatgtcatccgactcagcgttttagagctagaaatagcaagttaaaataaggctagtccgttatcaacttgaaaaagtggcaccgagtcggtgc

SEQ ID NO: 1854 - DNA, 21 bp, Homo sapiens
aaatgtcatctgactcagctg

SEQ ID NO: 1855 - DNA, 21 bp, Artificial Sequence
  Description of Artificial Sequence: Synthetic oligonucleotide
aaatgtcatccgactcagctg

SEQ ID NO: 1856 - DNA, 23 bp, Artificial Sequence
  Description of Artificial Sequence: Synthetic oligonucleotide
tcatccgactcagctggtattgg

SEQ ID NO: 1857 - DNA, 119 bp, Artificial Sequence
  Description of Artificial Sequence: Synthetic polynucleotide
attctaatacgactcactataggtcatccgactcagctggtatgttttagagctagaaatagcaagttaaaataaggctagtccgttatcaacttgaaaaagtggcaccgagtcggtgc

SEQ ID NO: 1858 - DNA, 23 bp, Artificial Sequence
  Description of Artificial Sequence: Synthetic oligonucleotide
catccgactcagctggtattggg

SEQ ID NO: 1859 - DNA, 119 bp, Artificial Sequence
  Description of Artificial Sequence: Synthetic polynucleotide
attctaatacgactcactataggcatccgactcagctggtattgttttagagctagaaatagcaagttaaaataaggctagtccgttatcaacttgaaaaagtggcaccgagtcggtgc

SEQ ID NO: 1860 - DNA, 23 bp, Artificial Sequence
  Description of Artificial Sequence: Synthetic oligonucleotide
aatcccaataccagctgagtcgg

SEQ ID NO: 1861 - DNA, 119 bp, Artificial Sequence
  Description of Artificial Sequence: Synthetic polynucleotide
attctaatacgactcactataggaatcccaataccagctgagtgttttagagctagaaatagcaagttaaaataaggctagtccgttatcaacttgaaaaagtggcaccgagtcggtgc

SEQ ID NO: 1862 - DNA, 23 bp, Artificial Sequence
  Description of Artificial Sequence: Synthetic oligonucleotide
ggggatacagcaggaagtgaagg

SEQ ID NO: 1863 - DNA, 119 bp, Artificial Sequence
  Description of Artificial Sequence: Synthetic polynucleotide
attctaatacgactcactataggggggatacagcaggaagtgagttttagagctagaaatagcaagttaaaataaggctagtccgttatcaacttgaaaaagtggcaccgagtcggtgc

SEQ ID NO: 1864 - DNA, 21 bp, Homo sapiens
caggaagtgagggtcactgcc

SEQ ID NO: 1865 - DNA, 21 bp, Artificial Sequence
  Description of Artificial Sequence: Synthetic oligonucleotide
caggaagtgaaggtcactgcc

SEQ ID NO: 1866 - DNA, 23 bp, Artificial Sequence
  Description of Artificial Sequence: Synthetic oligonucleotide
cggactggtagcagcttgtctgg

SEQ ID NO: 1867 - DNA, 119 bp, Artificial Sequence
  Description of Artificial Sequence: Synthetic polynucleotide
attctaatacgactcactataggcggactggtagcagcttgtcgttttagagctagaaatagcaagttaaaataaggctagtccgttatcaacttgaaaaagtggcaccgagtcggtgc

SEQ ID NO: 1868 - DNA, 21 bp, Homo sapiens
gactggtagccgcttgtctgg

SEQ ID NO: 1869 - DNA, 21 bp, Artificial Sequence
  Description of Artificial Sequence: Synthetic oligonucleotide
gactggtagcagcttgtctgg

SEQ ID NO: 1870 - DNA, 23 bp, Artificial Sequence
  Description of Artificial Sequence: Synthetic oligonucleotide
cagacaagctgctaccagtccgg

SEQ ID NO: 1871 - DNA, 119 bp, Artificial Sequence
  Description of Artificial Sequence: Synthetic polynucleotide
attctaatacgactcactataggcagacaagctgctaccagtcgttttagagctagaaatagcaagttaaaataaggctagtccgttatcaacttgaaaaagtggcaccgagtcggtgc

SEQ ID NO: 1872 - DNA, 23 bp, Artificial Sequence
  Description of Artificial Sequence: Synthetic oligonucleotide
ccgcatcctgcacctcgagccgg

SEQ ID NO: 1873 - DNA, 119 bp, Artificial Sequence
  Description of Artificial Sequence: Synthetic polynucleotide
attctaatacgactcactataggccgcatcctgcacctcgagcgttttagagctagaaatagcaagttaaaataaggctagtccgttatcaacttgaaaaagtggcaccgagtcggtgc

SEQ ID NO: 1874 - DNA, 23 bp, Artificial Sequence
  Description of Artificial Sequence: Synthetic oligonucleotide
cgcatcctgcacctcgagccggg

SEQ ID NO: 1875 - DNA, 119 bp, Artificial Sequence
  Description of Artificial Sequence: Synthetic polynucleotide
attctaatacgactcactataggcgcatcctgcacctcgagccgttttagagctagaaatagcaagttaaaataaggctagtccgttatcaacttgaaaaagtggcaccgagtcggtgc

SEQ ID NO: 1876 - DNA, 23 bp, Artificial Sequence
  Description of Artificial Sequence: Synthetic oligonucleotide
gaggtgcaggatgcggagcaagg

SEQ ID NO: 1877 - DNA, 119 bp, Artificial Sequence
  Description of Artificial Sequence: Synthetic polynucleotide
attctaatacgactcactatagggaggtgcaggatgcggagcagttttagagctagaaatagcaagttaaaataaggctagtccgttatcaacttgaaaaagtggcaccgagtcggtgc

SEQ ID NO: 1878 - DNA, 23 bp, Artificial Sequence
  Description of Artificial Sequence: Synthetic oligonucleotide
gatgcggagcaaggtgctgctgg

SEQ ID NO: 1879 - DNA, 119 bp, Artificial Sequence
  Description of Artificial Sequence: Synthetic polynucleotide
attctaatacgactcactatagggatgcggagcaaggtgctgcgttttagagctagaaatagcaagttaaaataaggctagtccgttatcaacttgaaaaagtggcaccgagtcggtgc

SEQ ID NO: 1880 - DNA, 23 bp, Artificial Sequence
  Description of Artificial Sequence: Synthetic oligonucleotide
ccggctcgaggtgcaggatgcgg

SEQ ID NO: 1881 - DNA, 119 bp, Artificial Sequence
  Description of Artificial Sequence: Synthetic polynucleotide
attctaatacgactcactataggccggctcgaggtgcaggatggttttagagctagaaatagcaagttaaaataaggctagtccgttatcaacttgaaaaagtggcaccgagtcggtgc

SEQ ID NO: 1882 - DNA, 23 bp, Artificial Sequence
  Description of Artificial Sequence: Synthetic oligonucleotide
agcagcccgcggtgtagatcagg

SEQ ID NO: 1883 - DNA, 119 bp, Artificial Sequence
  Description of Artificial Sequence: Synthetic polynucleotide
attctaatacgactcactataggagcagcccgcggtgtagatcgttttagagctagaaatagcaagttaaaataaggctagtccgttatcaacttgaaaaagtggcaccgagtcggtgc

SEQ ID NO: 1884 - DNA, 21 bp, Homo sapiens
cggaagtagccgcccgcggtg

SEQ ID NO: 1885 - DNA, 21 bp, Artificial Sequence
  Description of Artificial Sequence: Synthetic oligonucleotide
cggaagtagcagcccgcggtg

SEQ ID NO: 1886 - DNA, 23 bp, Artificial Sequence
  Description of Artificial Sequence: Synthetic oligonucleotide
ctgtcggaagtagcagcccgcgg

SEQ ID NO: 1887 - DNA, 119 bp, Artificial Sequence
  Description of Artificial Sequence: Synthetic polynucleotide
attctaatacgactcactataggctgtcggaagtagcagcccggttttagagctagaaatagcaagttaaaataaggctagtccgttatcaacttgaaaaagtggcaccgagtcggtgc

SEQ ID NO: 1888 - DNA, 23 bp, Artificial Sequence
  Description of Artificial Sequence: Synthetic oligonucleotide
agcccgcggtgtagatcaggcgg

SEQ ID NO: 1889 - DNA, 119 bp, Artificial Sequence
  Description of Artificial Sequence: Synthetic polynucleotide
attctaatacgactcactataggagcccgcggtgtagatcagggttttagagctagaaatagcaagttaaaataaggctagtccgttatcaacttgaaaaagtggcaccgagtcggtgc

SEQ ID NO: 1890 - DNA, 23 bp, Artificial Sequence
  Description of Artificial Sequence: Synthetic oligonucleotide
cacggataacgctgtcgatctgg

SEQ ID NO: 1891 - DNA, 119 bp, Artificial Sequence
  Description of Artificial Sequence: Synthetic polynucleotide
attctaatacgactcactataggcacggataacgctgtcgatcgttttagagctagaaatagcaagttaaaataaggctagtccgttatcaacttgaaaaagtggcaccgagtcggtgc

SEQ ID NO: 1892 - DNA, 21 bp, Homo sapiens
caggcacggacaacgctgtcg

SEQ ID NO: 1893 - DNA, 21 bp, Artificial Sequence
  Description of Artificial Sequence: Synthetic oligonucleotide
caggcacggataacgctgtcg

SEQ ID NO: 1894 - DNA, 23 bp, Artificial Sequence
  Description of Artificial Sequence: Synthetic oligonucleotide
tcaggtggtcccggctgatgagg

SEQ ID NO: 1895 - DNA, 119 bp, Artificial Sequence
  Description of Artificial Sequence: Synthetic polynucleotide
attctaatacgactcactataggtcaggtggtcccggctgatggttttagagctagaaatagcaagttaaaataaggctagtccgttatcaacttgaaaaagtggcaccgagtcggtgc

SEQ ID NO: 1896 - DNA, 21 bp, Homo sapiens
acgttcaggtcgtcccggctg

SEQ ID NO: 1897 - DNA, 21 bp, Artificial Sequence
  Description of Artificial Sequence: Synthetic oligonucleotide
acgttcaggtggtcccggctg

SEQ ID NO: 1898 - DNA, 23 bp, Artificial Sequence
  Description of Artificial Sequence: Synthetic oligonucleotide
actcgcagcgcacgttcaggtgg

SEQ ID NO: 1899 - DNA, 119 bp, Artificial Sequence
  Description of Artificial Sequence: Synthetic polynucleotide
attctaatacgactcactataggactcgcagcgcacgttcagggttttagagctagaaatagcaagttaaaataaggctagtccgttatcaacttgaaaaagtggcaccgagtcggtgc

SEQ ID NO: 1900 - DNA, 23 bp, Artificial Sequence
  Description of Artificial Sequence: Synthetic oligonucleotide
agcgcacgttcaggtggtcccgg

SEQ ID NO: 1901 - DNA, 119 bp, Artificial Sequence
  Description of Artificial Sequence: Synthetic polynucleotide
attctaatacgactcactataggagcgcacgttcaggtggtccgttttagagctagaaatagcaagttaaaataaggctagtccgttatcaacttgaaaaagtggcaccgagtcggtgc

SEQ ID NO: 1902 - DNA, 23 bp, Artificial Sequence
  Description of Artificial Sequence: Synthetic oligonucleotide
caggtggtcccggctgatgaggg

SEQ ID NO: 1903 - DNA, 119 bp, Artificial Sequence
  Description of Artificial Sequence: Synthetic polynucleotide
attctaatacgactcactataggcaggtggtcccggctgatgagttttagagctagaaatagcaagttaaaataaggctagtccgttatcaacttgaaaaagtggcaccgagtcggtgc

SEQ ID NO: 1904 - DNA, 23 bp, Artificial Sequence
  Description of Artificial Sequence: Synthetic oligonucleotide
catggagatggagggcgtgtagg

SEQ ID NO: 1905 - DNA, 119 bp, Artificial Sequence
  Description of Artificial Sequence: Synthetic polynucleotide
attctaatacgactcactataggcatggagatggagggcgtgtgttttagagctagaaatagcaagttaaaataaggctagtccgttatcaacttgaaaaagtggcaccgagtcggtgc

SEQ ID NO: 1906 - DNA, 21 bp, Homo sapiens
gagatggaggccgtgtaggcg

SEQ ID NO: 1907 - DNA, 21 bp, Artificial Sequence
  Description of Artificial Sequence: Synthetic oligonucleotide
gagatggagggcgtgtaggcg

SEQ ID NO: 1908 - DNA, 23 bp, Artificial Sequence
  Description of Artificial Sequence: Synthetic oligonucleotide
gcgtgtaggcgaattcaatgagg

SEQ ID NO: 1909 - DNA, 119 bp, Artificial Sequence
  Description of Artificial Sequence: Synthetic polynucleotide
attctaatacgactcactatagggcgtgtaggcgaattcaatggttttagagctagaaatagcaagttaaaataaggctagtccgttatcaacttgaaaaagtggcaccgagtcggtgc

SEQ ID NO: 1910 - DNA, 23 bp, Artificial Sequence
  Description of Artificial Sequence: Synthetic oligonucleotide
ctacacgccctccatctccatgg

SEQ ID NO: 1911 - DNA, 119 bp, Artificial Sequence
  Description of Artificial Sequence: Synthetic polynucleotide
attctaatacgactcactataggctacacgccctccatctccagttttagagctagaaatagcaagttaaaataaggctagtccgttatcaacttgaaaaagtggcaccgagtcggtgc

SEQ ID NO: 1912 - DNA, 23 bp, Artificial Sequence
  Description of Artificial Sequence: Synthetic oligonucleotide
tacacgccctccatctccatggg

SEQ ID NO: 1913 - DNA, 119 bp, Artificial Sequence
  Description of Artificial Sequence: Synthetic polynucleotide
attctaatacgactcactataggtacacgccctccatctccatgttttagagctagaaatagcaagttaaaataaggctagtccgttatcaacttgaaaaagtggcaccgagtcggtgc

SEQ ID NO: 1914 - DNA, 23 bp, Artificial Sequence
  Description of Artificial Sequence: Synthetic oligonucleotide
acacggcccgcagcagcgcctgg

SEQ ID NO: 1915 - DNA, 119 bp, Artificial Sequence
  Description of Artificial Sequence: Synthetic polynucleotide
attctaatacgactcactataggacacggcccgcagcagcgccgttttagagctagaaatagcaagttaaaataaggctagtccgttatcaacttgaaaaagtggcaccgagtcggtgc

SEQ ID NO: 1916 - DNA, 21 bp, Homo sapiens
gagtggcagcgcacggcccgc

SEQ ID NO: 1917 - DNA, 21 bp, Artificial Sequence
  Description of Artificial Sequence: Synthetic oligonucleotide
gagtggcagcacacggcccgc

SEQ ID NO: 1918 - DNA, 23 bp, Artificial Sequence
  Description of Artificial Sequence: Synthetic oligonucleotide
cgtcaacgagtggcagcacacgg

SEQ ID NO: 1919 - DNA, 119 bp, Artificial Sequence
  Description of Artificial Sequence: Synthetic polynucleotide
attctaatacgactcactataggcgtcaacgagtggcagcacagttttagagctagaaatagcaagttaaaataaggctagtccgttatcaacttgaaaaagtggcaccgagtcggtgc

SEQ ID NO: 1920 - DNA, 23 bp, Artificial Sequence
  Description of Artificial Sequence: Synthetic oligonucleotide
tccatttatgtgtttgttatagg

SEQ ID NO: 1921 - DNA, 119 bp, Artificial Sequence
  Description of Artificial Sequence: Synthetic polynucleotide
attctaatacgactcactataggtccatttatgtgtttgttatgttttagagctagaaatagcaagttaaaataaggctagtccgttatcaacttgaaaaagtggcaccgagtcggtgc

SEQ ID NO: 1922 - DNA, 23 bp, Artificial Sequence
  Description of Artificial Sequence: Synthetic oligonucleotide
gtttgttataggtaaatgcttgg

SEQ ID NO: 1923 - DNA, 119 bp, Artificial Sequence
  Description of Artificial Sequence: Synthetic polynucleotide
attctaatacgactcactatagggtttgttataggtaaatgctgttttagagctagaaatagcaagttaaaataaggctagtccgttatcaacttgaaaaagtggcaccgagtcggtgc

SEQ ID NO: 1924 - DNA, 23 bp, Artificial Sequence
  Description of Artificial Sequence: Synthetic oligonucleotide
acctataacaaacacataaatgg

SEQ ID NO: 1925 - DNA, 119 bp, Artificial Sequence
  Description of Artificial Sequence: Synthetic polynucleotide
attctaatacgactcactataggacctataacaaacacataaagttttagagctagaaatagcaagttaaaataaggctagtccgttatcaacttgaaaaagtggcaccgagtcggtgc

SEQ ID NO: 1926 - DNA, 23 bp, Artificial Sequence
  Description of Artificial Sequence: Synthetic oligonucleotide
aactcctctgtctctctccgagg

SEQ ID NO: 1927 - DNA, 119 bp, Artificial Sequence
  Description of Artificial Sequence: Synthetic polynucleotide
attctaatacgactcactataggaactcctctgtctctctccggttttagagctagaaatagcaagttaaaataaggctagtccgttatcaacttgaaaaagtggcaccgagtcggtgc

SEQ ID NO: 1928 - DNA, 21 bp, Homo sapiens
tgaactcctcggtctctctcc

SEQ ID NO: 1929 - DNA, 21 bp, Artificial Sequence
  Description of Artificial Sequence: Synthetic oligonucleotide
tgaactcctctgtctctctcc

SEQ ID NO: 1930 - DNA, 23 bp, Artificial Sequence
  Description of Artificial Sequence: Synthetic oligonucleotide
cctctgtctctctccgaggtagg

SEQ ID NO: 1931 - DNA, 119 bp, Artificial Sequence
  Description of Artificial Sequence: Synthetic polynucleotide
attctaatacgactcactataggcctctgtctctctccgaggtgttttagagctagaaatagcaagttaaaataaggctagtccgttatcaacttgaaaaagtggcaccgagtcggtgc

SEQ ID NO: 1932 - DNA, 23 bp, Artificial Sequence
  Description of Artificial Sequence: Synthetic oligonucleotide
ctctgtctctctccgaggtaggg

SEQ ID NO: 1933 - DNA, 119 bp, Artificial Sequence
  Description of Artificial Sequence: Synthetic polynucleotide
attctaatacgactcactataggctctgtctctctccgaggtagttttagagctagaaatagcaagttaaaataaggctagtccgttatcaacttgaaaaagtggcaccgagtcggtgc

SEQ ID NO: 1934 - DNA, 23 bp, Artificial Sequence
  Description of Artificial Sequence: Synthetic oligonucleotide
tctgtctctctccgaggtagggg

SEQ ID NO: 1935 - DNA, 119 bp, Artificial Sequence
  Description of Artificial Sequence: Synthetic polynucleotide
attctaatacgactcactataggtctgtctctctccgaggtaggttttagagctagaaatagcaagttaaaataaggctagtccgttatcaacttgaaaaagtggcaccgagtcggtgc

SEQ ID NO: 1936 - DNA, 23 bp, Artificial Sequence
  Description of Artificial Sequence: Synthetic oligonucleotide
cctacctcggagagagacagagg

SEQ ID NO: 1937 - DNA, 119 bp, Artificial Sequence
  Description of Artificial Sequence: Synthetic polynucleotide
attctaatacgactcactataggcctacctcggagagagacaggttttagagctagaaatagcaagttaaaataaggctagtccgttatcaacttgaaaaagtggcaccgagtcggtgc

SEQ ID NO: 1938 - DNA, 23 bp, Artificial Sequence
  Description of Artificial Sequence: Synthetic oligonucleotide
agaggagttcaacgatctcctgg

SEQ ID NO: 1939 - DNA, 119 bp, Artificial Sequence
  Description of Artificial Sequence: Synthetic polynucleotide
attctaatacgactcactataggagaggagttcaacgatctccgttttagagctagaaatagcaagttaaaataaggctagtccgttatcaacttgaaaaagtggcaccgagtcggtgc

SEQ ID NO: 1940 - DNA, 23 bp, Artificial Sequence
  Description of Artificial Sequence: Synthetic oligonucleotide
tttcttagaactattgccattgg

SEQ ID NO: 1941 - DNA, 119 bp, Artificial Sequence
  Description of Artificial Sequence: Synthetic polynucleotide
attctaatacgactcactataggtttcttagaactattgccatgttttagagctagaaatagcaagttaaaataaggctagtccgttatcaacttgaaaaagtggcaccgagtcggtgc

SEQ ID NO: 1942 - DNA, 23 bp, Artificial Sequence
  Description of Artificial Sequence: Synthetic oligonucleotide
gcaattgggggctgaattatagg

SEQ ID NO: 1943 - DNA, 119 bp, Artificial Sequence
  Description of Artificial Sequence: Synthetic polynucleotide
attctaatacgactcactatagggcaattgggggctgaattatgttttagagctagaaatagcaagttaaaataaggctagtccgttatcaacttgaaaaagtggcaccgagtcggtgc

SEQ ID NO: 1944 - DNA, 21 bp, Homo sapiens
gggctgaattctaggaggatt

SEQ ID NO: 1945 - DNA, 21 bp, Artificial Sequence
  Description of Artificial Sequence: Synthetic oligonucleotide
gggctgaattataggaggatt

SEQ ID NO: 1946 - DNA, 23 bp, Artificial Sequence
  Description of Artificial Sequence: Synthetic oligonucleotide
attgggggctgaattataggagg

SEQ ID NO: 1947 - DNA, 119 bp, Artificial Sequence
  Description of Artificial Sequence: Synthetic polynucleotide
attctaatacgactcactataggattgggggctgaattatagggttttagagctagaaatagcaagttaaaataaggctagtccgttatcaacttgaaaaagtggcaccgagtcggtgc

SEQ ID NO: 1948 - DNA, 23 bp, Artificial Sequence
  Description of Artificial Sequence: Synthetic oligonucleotide
gctgaattataggaggattgagg

SEQ ID NO: 1949 - DNA, 119 bp, Artificial Sequence
  Description of Artificial Sequence: Synthetic polynucleotide
attctaatacgactcactatagggctgaattataggaggattggttttagagctagaaatagcaagttaaaataaggctagtccgttatcaacttgaaaaagtggcaccgagtcggtgc

SEQ ID NO: 1950 - DNA, 23 bp, Artificial Sequence
  Description of Artificial Sequence: Synthetic oligonucleotide
ttataggaggattgaggggcagg

SEQ ID NO: 1951 - DNA, 119 bp, Artificial Sequence
  Description of Artificial Sequence: Synthetic polynucleotide
attctaatacgactcactataggttataggaggattgaggggcgttttagagctagaaatagcaagttaaaataaggctagtccgttatcaacttgaaaaagtggcaccgagtcggtgc

SEQ ID NO: 1952 - DNA, 23 bp, Artificial Sequence
  Description of Artificial Sequence: Synthetic oligonucleotide
ctgaattataggaggattgaggg

SEQ ID NO: 1953 - DNA, 119 bp, Artificial Sequence
  Description of Artificial Sequence: Synthetic polynucleotide
attctaatacgactcactataggctgaattataggaggattgagttttagagctagaaatagcaagttaaaataaggctagtccgttatcaacttgaaaaagtggcaccgagtcggtgc

SEQ ID NO: 1954 - DNA, 23 bp, Artificial Sequence
  Description of Artificial Sequence: Synthetic oligonucleotide
tgaattataggaggattgagggg

SEQ ID NO: 1955 - DNA, 119 bp, Artificial Sequence
  Description of Artificial Sequence: Synthetic polynucleotide
attctaatacgactcactataggtgaattataggaggattgaggttttagagctagaaatagcaagttaaaataaggctagtccgttatcaacttgaaaaagtggcaccgagtcggtgc

SEQ ID NO: 1956 - DNA, 23 bp, Artificial Sequence
  Description of Artificial Sequence: Synthetic oligonucleotide
gtggaaaatgtagcaaacattgg

SEQ ID NO: 1957 - DNA, 119 bp, Artificial Sequence
  Description of Artificial Sequence: Synthetic polynucleotide
attctaatacgactcactatagggtggaaaatgtagcaaacatgttttagagctagaaatagcaagttaaaataaggctagtccgttatcaacttgaaaaagtggcaccgagtcggtgc

SEQ ID NO: 1958 - DNA, 23 bp, Artificial Sequence
  Description of Artificial Sequence: Synthetic oligonucleotide
cacagaggacgatgtggaacagg

SEQ ID NO: 1959 - DNA, 119 bp, Artificial Sequence
  Description of Artificial Sequence: Synthetic polynucleotide
attctaatacgactcactataggcacagaggacgatgtggaacgttttagagctagaaatagcaagttaaaataaggctagtccgttatcaacttgaaaaagtggcaccgagtcggtgc

SEQ ID NO: 1960 - DNA, 21 bp, Homo sapiens
cggctgcctgctccacatcgt

SEQ ID NO: 1961 - DNA, 21 bp, Artificial Sequence
  Description of Artificial Sequence: Synthetic oligonucleotide
cggctgcctgttccacatcgt

SEQ ID NO: 1962 - DNA, 23 bp, Artificial Sequence
  Description of Artificial Sequence: Synthetic oligonucleotide
gtggaacaggcagccgatgaagg

SEQ ID NO: 1963 - DNA, 119 bp, Artificial Sequence
  Description of Artificial Sequence: Synthetic polynucleotide
attctaatacgactcactatagggtggaacaggcagccgatgagttttagagctagaaatagcaagttaaaataaggctagtccgttatcaacttgaaaaagtggcaccgagtcggtgc

SEQ ID NO: 1964 - DNA, 23 bp, Artificial Sequence
  Description of Artificial Sequence: Synthetic oligonucleotide
gatagaggcatctcaagtgcagg

SEQ ID NO: 1965 - DNA, 119 bp, Artificial Sequence
  Description of Artificial Sequence: Synthetic polynucleotide
attctaatacgactcactatagggatagaggcatctcaagtgcgttttagagctagaaatagcaagttaaaataaggctagtccgttatcaacttgaaaaagtggcaccgagtcggtgc

SEQ ID NO: 1966 - DNA, 21 bp, Homo sapiens
ggatagaggcgtctcaagtgc

SEQ ID NO: 1967 - DNA, 21 bp, Artificial Sequence
  Description of Artificial Sequence: Synthetic oligonucleotide
ggatagaggcatctcaagtgc

SEQ ID NO: 1968 - DNA, 23 bp, Artificial Sequence
  Description of Artificial Sequence: Synthetic oligonucleotide
ggcatctcaagtgcaggagatgg

SEQ ID NO: 1969 - DNA, 119 bp, Artificial Sequence
  Description of Artificial Sequence: Synthetic polynucleotide
attctaatacgactcactataggggcatctcaagtgcaggagagttttagagctagaaatagcaagttaaaataaggctagtccgttatcaacttgaaaaagtggcaccgagtcggtgc

SEQ ID NO: 1970 - DNA, 23 bp, Artificial Sequence
  Description of Artificial Sequence: Synthetic oligonucleotide
gcatctcaagtgcaggagatggg

SEQ ID NO: 1971 - DNA, 119 bp, Artificial Sequence
  Description of Artificial Sequence: Synthetic polynucleotide
attctaatacgactcactatagggcatctcaagtgcaggagatgttttagagctagaaatagcaagttaaaataaggctagtccgttatcaacttgaaaaagtggcaccgagtcggtgc

SEQ ID NO: 1972 - DNA, 23 bp, Artificial Sequence
  Description of Artificial Sequence: Synthetic oligonucleotide
catctcaagtgcaggagatgggg

SEQ ID NO: 1973 - DNA, 119 bp, Artificial Sequence
  Description of Artificial Sequence: Synthetic polynucleotide
attctaatacgactcactataggcatctcaagtgcaggagatggttttagagctagaaatagcaagttaaaataaggctagtccgttatcaacttgaaaaagtggcaccgagtcggtgc

SEQ ID NO: 1974 - DNA, 23 bp, Artificial Sequence
  Description of Artificial Sequence: Synthetic oligonucleotide
atctcaagtgcaggagatggggg

SEQ ID NO: 1975 - DNA, 119 bp, Artificial Sequence
  Description of Artificial Sequence: Synthetic polynucleotide
attctaatacgactcactataggatctcaagtgcaggagatgggttttagagctagaaatagcaagttaaaataaggctagtccgttatcaacttgaaaaagtggcaccgagtcggtgc

SEQ ID NO: 1976 - DNA, 23 bp, Artificial Sequence
  Description of Artificial Sequence: Synthetic oligonucleotide
ttctgctgagcacgccccacagg

SEQ ID NO: 1977 - DNA, 119 bp, Artificial Sequence
  Description of Artificial Sequence: Synthetic polynucleotide
attctaatacgactcactataggttctgctgagcacgccccacgttttagagctagaaatagcaagttaaaataaggctagtccgttatcaacttgaaaaagtggcaccgagtcggtgc

SEQ ID NO: 1978 - DNA, 21 bp, Homo sapiens
tctgctgagcccgccccacag

SEQ ID NO: 1979 - DNA, 21 bp, Artificial Sequence
  Description of Artificial Sequence: Synthetic oligonucleotide
tctgctgagcacgccccacag

SEQ ID NO: 1980 - DNA, 23 bp, Artificial Sequence
  Description of Artificial Sequence: Synthetic oligonucleotide
ctgagcacgccccacaggcccgg

SEQ ID NO: 1981 - DNA, 119 bp, Artificial Sequence
  Description of Artificial Sequence: Synthetic polynucleotide
attctaatacgactcactataggctgagcacgccccacaggccgttttagagctagaaatagcaagttaaaataaggctagtccgttatcaacttgaaaaagtggcaccgagtcggtgc

SEQ ID NO: 1982 - DNA, 23 bp, Artificial Sequence
  Description of Artificial Sequence: Synthetic oligonucleotide
ggcggagcacagcagctctcagg

SEQ ID NO: 1983 - DNA, 119 bp, Artificial Sequence
  Description of Artificial Sequence: Synthetic polynucleotide
attctaatacgactcactataggggcggagcacagcagctctcgttttagagctagaaatagcaagttaaaataaggctagtccgttatcaacttgaaaaagtggcaccgagtcggtgc

SEQ ID NO: 1984 - DNA, 21 bp, Homo sapiens
gcgagggggcagagcacagca

SEQ ID NO: 1985 - DNA, 21 bp, Artificial Sequence
  Description of Artificial Sequence: Synthetic oligonucleotide
gcgagggggcggagcacagca

SEQ ID NO: 1986 - DNA, 23 bp, Artificial Sequence
  Description of Artificial Sequence: Synthetic oligonucleotide
gagggcagtgagcgagggggcgg

SEQ ID NO: 1987 - DNA, 119 bp, Artificial Sequence
  Description of Artificial Sequence: Synthetic polynucleotide
attctaatacgactcactatagggagggcagtgagcgaggggggttttagagctagaaatagcaagttaaaataaggctagtccgttatcaacttgaaaaagtggcaccgagtcggtgc

SEQ ID NO: 1988 - DNA, 23 bp, Artificial Sequence
  Description of Artificial Sequence: Synthetic oligonucleotide
gcggagcacagcagctctcaggg

SEQ ID NO: 1989 - DNA, 119 bp, Artificial Sequence
  Description of Artificial Sequence: Synthetic polynucleotide
attctaatacgactcactatagggcggagcacagcagctctcagttttagagctagaaatagcaagttaaaataaggctagtccgttatcaacttgaaaaagtggcaccgagtcggtgc

SEQ ID NO: 1990 - DNA, 23 bp, Artificial Sequence
  Description of Artificial Sequence: Synthetic oligonucleotide
cggagcacagcagctctcagggg

SEQ ID NO: 1991 - DNA, 119 bp, Artificial Sequence
  Description of Artificial Sequence: Synthetic polynucleotide
attctaatacgactcactataggcggagcacagcagctctcaggttttagagctagaaatagcaagttaaaataaggctagtccgttatcaacttgaaaaagtggcaccgagtcggtgc

SEQ ID NO: 1992 - DNA, 23 bp, Artificial Sequence
  Description of Artificial Sequence: Synthetic oligonucleotide
ggagcacagcagctctcaggggg

SEQ ID NO: 1993 - DNA, 119 bp, Artificial Sequence
  Description of Artificial Sequence: Synthetic polynucleotide
attctaatacgactcactataggggagcacagcagctctcagggttttagagctagaaatagcaagttaaaataaggctagtccgttatcaacttgaaaaagtggcaccgagtcggtgc

SEQ ID NO: 1994 - DNA, 23 bp, Artificial Sequence
  Description of Artificial Sequence: Synthetic oligonucleotide
cggggtatgctgctcagcaaagg

SEQ ID NO: 1995 - DNA, 119 bp, Artificial Sequence
  Description of Artificial Sequence: Synthetic polynucleotide
attctaatacgactcactataggcggggtatgctgctcagcaagttttagagctagaaatagcaagttaaaataaggctagtccgttatcaacttgaaaaagtggcaccgagtcggtgc

SEQ ID NO: 1996 - DNA, 23 bp, Artificial Sequence
  Description of Artificial Sequence: Synthetic oligonucleotide
tatgctgctcagcaaaggagcgg

SEQ ID NO: 1997 - DNA, 119 bp, Artificial Sequence
  Description of Artificial Sequence: Synthetic polynucleotide
attctaatacgactcactataggtatgctgctcagcaaaggaggttttagagctagaaatagcaagttaaaataaggctagtccgttatcaacttgaaaaagtggcaccgagtcggtgc

SEQ ID NO: 1998 - DNA, 23 bp, Artificial Sequence
  Description of Artificial Sequence: Synthetic oligonucleotide
ctttgctgagcagcataccccgg

SEQ ID NO: 1999 - DNA, 119 bp, Artificial Sequence
  Description of Artificial Sequence: Synthetic polynucleotide
attctaatacgactcactataggctttgctgagcagcatacccgttttagagctagaaatagcaagttaaaataaggctagtccgttatcaacttgaaaaagtggcaccgagtcggtgc

SEQ ID NO: 2000 - DNA, 23 bp, Artificial Sequence
  Description of Artificial Sequence: Synthetic oligonucleotide
gtggttccccaggttcagacagg

SEQ ID NO: 2001 - DNA, 119 bp, Artificial Sequence
  Description of Artificial Sequence: Synthetic polynucleotide
attctaatacgactcactatagggtggttccccaggttcagacgttttagagctagaaatagcaagttaaaataaggctagtccgttatcaacttgaaaaagtggcaccgagtcggtgc

SEQ ID NO: 2002 - DNA, 21 bp, Homo sapiens
gttccccaggctcagacaggg

SEQ ID NO: 2003 - DNA, 21 bp, Artificial Sequence
  Description of Artificial Sequence: Synthetic oligonucleotide
gttccccaggttcagacaggg

SEQ ID NO: 2004 - DNA, 23 bp, Artificial Sequence
  Description of Artificial Sequence: Synthetic oligonucleotide
tccccaggttcagacagggctgg

SEQ ID NO: 2005 - DNA, 119 bp, Artificial Sequence
  Description of Artificial Sequence: Synthetic polynucleotide
attctaatacgactcactataggtccccaggttcagacagggcgttttagagctagaaatagcaagttaaaataaggctagtccgttatcaacttgaaaaagtggcaccgagtcggtgc

SEQ ID NO: 2006 - DNA, 23 bp, Artificial Sequence
  Description of Artificial Sequence: Synthetic oligonucleotide
tggttccccaggttcagacaggg

SEQ ID NO: 2007 - DNA, 119 bp, Artificial Sequence
  Description of Artificial Sequence: Synthetic polynucleotide
attctaatacgactcactataggtggttccccaggttcagacagttttagagctagaaatagcaagttaaaataaggctagtccgttatcaacttgaaaaagtggcaccgagtcggtgc

SEQ ID NO: 2008 - DNA, 23 bp, Artificial Sequence
  Description of Artificial Sequence: Synthetic oligonucleotide
gagccagccctgtctgaacctgg

SEQ ID NO: 2009 - DNA, 119 bp, Artificial Sequence
  Description of Artificial Sequence: Synthetic polynucleotide
attctaatacgactcactatagggagccagccctgtctgaaccgttttagagctagaaatagcaagttaaaataaggctagtccgttatcaacttgaaaaagtggcaccgagtcggtgc

SEQ ID NO: 2010 - DNA, 23 bp, Artificial Sequence
  Description of Artificial Sequence: Synthetic oligonucleotide
agccagccctgtctgaacctggg

SEQ ID NO: 2011 - DNA, 119 bp, Artificial Sequence
  Description of Artificial Sequence: Synthetic polynucleotide
attctaatacgactcactataggagccagccctgtctgaacctgttttagagctagaaatagcaagttaaaataaggctagtccgttatcaacttgaaaaagtggcaccgagtcggtgc

SEQ ID NO: 2012 - DNA, 23 bp, Artificial Sequence
  Description of Artificial Sequence: Synthetic oligonucleotide
gccagccctgtctgaacctgggg

SEQ ID NO: 2013 - DNA, 119 bp, Artificial Sequence
  Description of Artificial Sequence: Synthetic polynucleotide
attctaatacgactcactatagggccagccctgtctgaacctggttttagagctagaaatagcaagttaaaataaggctagtccgttatcaacttgaaaaagtggcaccgagtcggtgc

SEQ ID NO: 2014 - DNA, 23 bp, Artificial Sequence
  Description of Artificial Sequence: Synthetic oligonucleotide
aagggagataaggatgccccagg

SEQ ID NO: 2015 - DNA, 119 bp, Artificial Sequence
  Description of Artificial Sequence: Synthetic polynucleotide
attctaatacgactcactataggaagggagataaggatgccccgttttagagctagaaatagcaagttaaaataaggctagtccgttatcaacttgaaaaagtggcaccgagtcggtgc

SEQ ID NO: 2016 - DNA, 23 bp, Homo sapiens
gataaggatggttccccaggggg

SEQ ID NO: 2017 - DNA, 20 bp, Artificial Sequence
  Description of Artificial Sequence: Synthetic oligonucleotide
gataaggatgccccaggggg

SEQ ID NO: 2018 - DNA, 23 bp, Artificial Sequence
  Description of Artificial Sequence: Synthetic oligonucleotide
gataaggatgccccagggggagg

SEQ ID NO: 2019 - DNA, 119 bp, Artificial Sequence
  Description of Artificial Sequence: Synthetic polynucleotide
attctaatacgactcactatagggataaggatgccccaggggggttttagagctagaaatagcaagttaaaataaggctagtccgttatcaacttgaaaaagtggcaccgagtcggtgc

SEQ ID NO: 2020 - DNA, 23 bp, Artificial Sequence
  Description of Artificial Sequence: Synthetic oligonucleotide
tgccccagggggagggaacaagg

SEQ ID NO: 2021 - DNA, 119 bp, Artificial Sequence
  Description of Artificial Sequence: Synthetic polynucleotide
attctaatacgactcactataggtgccccagggggagggaacagttttagagctagaaatagcaagttaaaataaggctagtccgttatcaacttgaaaaagtggcaccgagtcggtgc

SEQ ID NO: 2022 - DNA, 23 bp, Artificial Sequence
  Description of Artificial Sequence: Synthetic oligonucleotide
agggagataaggatgccccaggg

SEQ ID NO: 2023 - DNA, 119 bp, Artificial Sequence
  Description of Artificial Sequence: Synthetic polynucleotide
attctaatacgactcactataggagggagataaggatgccccagttttagagctagaaatagcaagttaaaataaggctagtccgttatcaacttgaaaaagtggcaccgagtcggtgc

SEQ ID NO: 2024 - DNA, 23 bp, Artificial Sequence
  Description of Artificial Sequence: Synthetic oligonucleotide
gggagataaggatgccccagggg

SEQ ID NO: 2025 - DNA, 119 bp, Artificial Sequence
  Description of Artificial Sequence: Synthetic polynucleotide
attctaatacgactcactatagggggagataaggatgccccaggttttagagctagaaatagcaagttaaaataaggctagtccgttatcaacttgaaaaagtggcaccgagtcggtgc

SEQ ID NO: 2026 - DNA, 23 bp, Artificial Sequence
  Description of Artificial Sequence: Synthetic oligonucleotide
ggagataaggatgccccaggggg

SEQ ID NO: 2027 - DNA, 119 bp, Artificial Sequence
  Description of Artificial Sequence: Synthetic polynucleotide
attctaatacgactcactataggggagataaggatgccccagggttttagagctagaaatagcaagttaaaataaggctagtccgttatcaacttgaaaaagtggcaccgagtcggtgc

SEQ ID NO: 2028 - DNA, 23 bp, Artificial Sequence
  Description of Artificial Sequence: Synthetic oligonucleotide
ataaggatgccccagggggaggg

SEQ ID NO: 2029 - DNA, 119 bp, Artificial Sequence
  Description of Artificial Sequence: Synthetic polynucleotide
attctaatacgactcactataggataaggatgccccagggggagttttagagctagaaatagcaagttaaaataaggctagtccgttatcaacttgaaaaagtggcaccgagtcggtgc

SEQ ID NO: 2030 - DNA, 23 bp, Artificial Sequence
  Description of Artificial Sequence: Synthetic oligonucleotide
gccccagggggagggaacaaggg

SEQ ID NO: 2031 - DNA, 119 bp, Artificial Sequence
  Description of Artificial Sequence: Synthetic polynucleotide
attctaatacgactcactatagggccccagggggagggaacaagttttagagctagaaatagcaagttaaaataaggctagtccgttatcaacttgaaaaagtggcaccgagtcggtgc

SEQ ID NO: 2032 - DNA, 23 bp, Artificial Sequence
  Description of Artificial Sequence: Synthetic oligonucleotide
gcatccttatctcccttgcttgg

SEQ ID NO: 2033 - DNA, 119 bp, Artificial Sequence
  Description of Artificial Sequence: Synthetic polynucleotide
attctaatacgactcactatagggcatccttatctcccttgctgttttagagctagaaatagcaagttaaaataaggctagtccgttatcaacttgaaaaagtggcaccgagtcggtgc

SEQ ID NO: 2034 - DNA, 23 bp, Artificial Sequence
  Description of Artificial Sequence: Synthetic oligonucleotide
gtagttggagctagtggcgtagg

SEQ ID NO: 2035 - DNA, 119 bp, Artificial Sequence
  Description of Artificial Sequence: Synthetic polynucleotide
attctaatacgactcactatagggtagttggagctagtggcgtgttttagagctagaaatagcaagttaaaataaggctagtccgttatcaacttgaaaaagtggcaccgagtcggtgc

SEQ ID NO: 2036 - DNA, 21 bp, Homo sapiens
cctacgccaccagctccaact

SEQ ID NO: 2037 - DNA, 21 bp, Artificial Sequence
  Description of Artificial Sequence: Synthetic oligonucleotide
cctacgccactagctccaact

SEQ ID NO: 2038 - DNA, 23 bp, Artificial Sequence
  Description of Artificial Sequence: Synthetic oligonucleotide
cttgtggtagttggagctagtgg

SEQ ID NO: 2039 - DNA, 119 bp, Artificial Sequence
  Description of Artificial Sequence: Synthetic polynucleotide
attctaatacgactcactataggcttgtggtagttggagctaggttttagagctagaaatagcaagttaaaataaggctagtccgttatcaacttgaaaaagtggcaccgagtcggtgc

SEQ ID NO: 2040 - DNA, 23 bp, Artificial Sequence
  Description of Artificial Sequence: Synthetic oligonucleotide
tctcgacacagcaggtcatgagg

SEQ ID NO: 2041 - DNA, 119 bp, Artificial Sequence
  Description of Artificial Sequence: Synthetic polynucleotide
attctaatacgactcactataggtctcgacacagcaggtcatggttttagagctagaaatagcaagttaaaataaggctagtccgttatcaacttgaaaaagtggcaccgagtcggtgc

SEQ ID NO: 2042 - DNA, 21 bp, Homo sapiens
tgtactcctcttgacctgctg

SEQ ID NO: 2043 - DNA, 21 bp, Artificial Sequence
  Description of Artificial Sequence: Synthetic oligonucleotide
tgtactcctcatgacctgctg

SEQ ID NO: 2044 - DNA, 23 bp, Artificial Sequence
  Description of Artificial Sequence: Synthetic oligonucleotide
atgaggagtacagtgcaatgagg

SEQ ID NO: 2045 - DNA, 119 bp, Artificial Sequence
  Description of Artificial Sequence: Synthetic polynucleotide
attctaatacgactcactataggatgaggagtacagtgcaatggttttagagctagaaatagcaagttaaaataaggctagtccgttatcaacttgaaaaagtggcaccgagtcggtgc

SEQ ID NO: 2046 - DNA, 23 bp, Artificial Sequence
  Description of Artificial Sequence: Synthetic oligonucleotide
tgaggagtacagtgcaatgaggg

SEQ ID NO: 2047 - DNA, 119 bp, Artificial Sequence
  Description of Artificial Sequence: Synthetic polynucleotide
attctaatacgactcactataggtgaggagtacagtgcaatgagttttagagctagaaatagcaagttaaaataaggctagtccgttatcaacttgaaaaagtggcaccgagtcggtgc

SEQ ID NO: 2048 - DNA, 23 bp, Artificial Sequence
  Description of Artificial Sequence: Synthetic oligonucleotide
gtagttggagctgatggcgtagg

SEQ ID NO: 2049 - DNA, 119 bp, Artificial Sequence
  Description of Artificial Sequence: Synthetic polynucleotide
attctaatacgactcactatagggtagttggagctgatggcgtgttttagagctagaaatagcaagttaaaataaggctagtccgttatcaacttgaaaaagtggcaccgagtcggtgc

SEQ ID NO: 2050 - DNA, 21 bp, Homo sapiens
gcctacgccaccagctccaac

SEQ ID NO: 2051 - DNA, 21 bp, Artificial Sequence
  Description of Artificial Sequence: Synthetic oligonucleotide
gcctacgccatcagctccaac

SEQ ID NO: 2052 - DNA, 23 bp, Artificial Sequence
  Description of Artificial Sequence: Synthetic oligonucleotide
cttgtggtagttggagctgatgg

SEQ ID NO: 2053 - DNA, 119 bp, Artificial Sequence
  Description of Artificial Sequence: Synthetic polynucleotide
attctaatacgactcactataggcttgtggtagttggagctgagttttagagctagaaatagcaagttaaaataaggctagtccgttatcaacttgaaaaagtggcaccgagtcggtgc

SEQ ID NO: 2054 - DNA, 23 bp, Artificial Sequence
  Description of Artificial Sequence: Synthetic oligonucleotide
ttggctgatgtttcaataaaagg

SEQ ID NO: 2055 - DNA, 119 bp, Artificial Sequence
  Description of Artificial Sequence: Synthetic polynucleotide
attctaatacgactcactataggttggctgatgtttcaataaagttttagagctagaaatagcaagttaaaataaggctagtccgttatcaacttgaaaaagtggcaccgagtcggtgc

SEQ ID NO: 2056 - DNA, 23 bp, Artificial Sequence
  Description of Artificial Sequence: Synthetic oligonucleotide
gttacttacctgtcttgtcttgg

SEQ ID NO: 2057 - DNA, 119 bp, Artificial Sequence
  Description of Artificial Sequence: Synthetic polynucleotide
attctaatacgactcactatagggttacttacctgtcttgtctgttttagagctagaaatagcaagttaaaataaggctagtccgttatcaacttgaaaaagtggcaccgagtcggtgc

SEQ ID NO: 2058 - DNA, 23 bp, Artificial Sequence
  Description of Artificial Sequence: Synthetic oligonucleotide
aacatcagccaagacaagacagg

SEQ ID NO: 2059 - DNA, 119 bp, Artificial Sequence
  Description of Artificial Sequence: Synthetic polynucleotide
attctaatacgactcactataggaacatcagccaagacaagacgttttagagctagaaatagcaagttaaaataaggctagtccgttatcaacttgaaaaagtggcaccgagtcggtgc

SEQ ID NO: 2060 - DNA, 23 bp, Artificial Sequence
  Description of Artificial Sequence: Synthetic oligonucleotide
gtagttggagctgttggcgtagg

SEQ ID NO: 2061 - DNA, 119 bp, Artificial Sequence
  Description of Artificial Sequence: Synthetic polynucleotide
attctaatacgactcactatagggtagttggagctgttggcgtgttttagagctagaaatagcaagttaaaataaggctagtccgttatcaacttgaaaaagtggcaccgagtcggtgc

SEQ ID NO: 2062 - DNA, 21 bp, Artificial Sequence
  Description of Artificial Sequence: Synthetic oligonucleotide
gcctacgccaacagctccaac

SEQ ID NO: 2063 - DNA, 23 bp, Artificial Sequence
  Description of Artificial Sequence: Synthetic oligonucleotide
cttgtggtagttggagctgttgg

SEQ ID NO: 2064 - DNA, 119 bp, Artificial Sequence
  Description of Artificial Sequence: Synthetic polynucleotide
attctaatacgactcactataggcttgtggtagttggagctgtgttttagagctagaaatagcaagttaaaataaggctagtccgttatcaacttgaaaaagtggcaccgagtcggtgc

SEQ ID NO: 2065 - DNA, 23 bp, Artificial Sequence
  Description of Artificial Sequence: Synthetic oligonucleotide
gtagttggagctgctggcgtagg

SEQ ID NO: 2066 - DNA, 119 bp, Artificial Sequence
  Description of Artificial Sequence: Synthetic polynucleotide
attctaatacgactcactatagggtagttggagctgctggcgtgttttagagctagaaatagcaagttaaaataaggctagtccgttatcaacttgaaaaagtggcaccgagtcggtgc

SEQ ID NO: 2067 - DNA, 21 bp, Artificial Sequence
  Description of Artificial Sequence: Synthetic oligonucleotide
gcctacgccagcagctccaac

SEQ ID NO: 2068 - DNA, 23 bp, Artificial Sequence
  Description of Artificial Sequence: Synthetic oligonucleotide
cttgtggtagttggagctgctgg

SEQ ID NO: 2069 - DNA, 119 bp, Artificial Sequence
  Description of Artificial Sequence: Synthetic polynucleotide
attctaatacgactcactataggcttgtggtagttggagctgcgttttagagctagaaatagcaagttaaaataaggctagtccgttatcaacttgaaaaagtggcaccgagtcggtgc

SEQ ID NO: 2070 - DNA, 23 bp, Artificial Sequence
  Description of Artificial Sequence: Synthetic oligonucleotide
agtgtcactgtttggttctgcgg

SEQ ID NO: 2071 - DNA, 119 bp, Artificial Sequence
  Description of Artificial Sequence: Synthetic polynucleotide
attctaatacgactcactataggagtgtcactgtttggttctggttttagagctagaaatagcaagttaaaataaggctagtccgttatcaacttgaaaaagtggcaccgagtcggtgc

SEQ ID NO: 2072 - DNA, 23 bp, Artificial Sequence
  Description of Artificial Sequence: Synthetic oligonucleotide
gtgtcactgtttggttctgcggg

SEQ ID NO: 2073 - DNA, 119 bp, Artificial Sequence
  Description of Artificial Sequence: Synthetic polynucleotide
attctaatacgactcactatagggtgtcactgtttggttctgcgttttagagctagaaatagcaagttaaaataaggctagtccgttatcaacttgaaaaagtggcaccgagtcggtgc

SEQ ID NO: 2074 - DNA, 23 bp, Artificial Sequence
  Description of Artificial Sequence: Synthetic oligonucleotide
ctttcttaccccgaagcagaagg

SEQ ID NO: 2075 - DNA, 119 bp, Artificial Sequence
  Description of Artificial Sequence: Synthetic polynucleotide
attctaatacgactcactataggctttcttaccccgaagcagagttttagagctagaaatagcaagttaaaataaggctagtccgttatcaacttgaaaaagtggcaccgagtcggtgc

SEQ ID NO: 2076 - DNA, 23 bp, Artificial Sequence
  Description of Artificial Sequence: Synthetic oligonucleotide
tcttaccccgaagcagaaggtgg

SEQ ID NO: 2077 - DNA, 119 bp, Artificial Sequence
  Description of Artificial Sequence: Synthetic polynucleotide
attctaatacgactcactataggtcttaccccgaagcagaagggttttagagctagaaatagcaagttaaaataaggctagtccgttatcaacttgaaaaagtggcaccgagtcggtgc

SEQ ID NO: 2078 - DNA, 23 bp, Artificial Sequence
  Description of Artificial Sequence: Synthetic oligonucleotide
cttaccccgaagcagaaggtggg

SEQ ID NO: 2079 - DNA, 119 bp, Artificial Sequence
  Description of Artificial Sequence: Synthetic polynucleotide
attctaatacgactcactataggcttaccccgaagcagaaggtgttttagagctagaaatagcaagttaaaataaggctagtccgttatcaacttgaaaaagtggcaccgagtcggtgc

SEQ ID NO: 2080 - DNA, 23 bp, Artificial Sequence
  Description of Artificial Sequence: Synthetic oligonucleotide
cttctgcttcggggtaagaaagg

SEQ ID NO: 2081 - DNA, 119 bp, Artificial Sequence
  Description of Artificial Sequence: Synthetic polynucleotide
attctaatacgactcactataggcttctgcttcggggtaagaagttttagagctagaaatagcaagttaaaataaggctagtccgttatcaacttgaaaaagtggcaccgagtcggtgc

SEQ ID NO: 2082 - DNA, 23 bp, Artificial Sequence
  Description of Artificial Sequence: Synthetic oligonucleotide
tcggggtaagaaaggcctcaagg

SEQ ID NO: 2083 - DNA, 119 bp, Artificial Sequence
  Description of Artificial Sequence: Synthetic polynucleotide
attctaatacgactcactataggtcggggtaagaaaggcctcagttttagagctagaaatagcaagttaaaataaggctagtccgttatcaacttgaaaaagtggcaccgagtcggtgc

SEQ ID NO: 2084 - DNA, 23 bp, Artificial Sequence
  Description of Artificial Sequence: Synthetic oligonucleotide
agttctcccaccttctgcttcgg

SEQ ID NO: 2085 - DNA, 119 bp, Artificial Sequence
  Description of Artificial Sequence: Synthetic polynucleotide
attctaatacgactcactataggagttctcccaccttctgcttgttttagagctagaaatagcaagttaaaataaggctagtccgttatcaacttgaaaaagtggcaccgagtcggtgc

SEQ ID NO: 2086 - DNA, 23 bp, Artificial Sequence
  Description of Artificial Sequence: Synthetic oligonucleotide
gttctcccaccttctgcttcggg

SEQ ID NO: 2087 - DNA, 119 bp, Artificial Sequence
  Description of Artificial Sequence: Synthetic polynucleotide
attctaatacgactcactatagggttctcccaccttctgcttcgttttagagctagaaatagcaagttaaaataaggctagtccgttatcaacttgaaaaagtggcaccgagtcggtgc

SEQ ID NO: 2088 - DNA, 23 bp, Artificial Sequence
  Description of Artificial Sequence: Synthetic oligonucleotide
ttctcccaccttctgcttcgggg

SEQ ID NO: 2089 - DNA, 119 bp, Artificial Sequence
  Description of Artificial Sequence: Synthetic polynucleotide
attctaatacgactcactataggttctcccaccttctgcttcggttttagagctagaaatagcaagttaaaataaggctagtccgttatcaacttgaaaaagtggcaccgagtcggtgc

SEQ ID NO: 2090 - DNA, 23 bp, Artificial Sequence
  Description of Artificial Sequence: Synthetic oligonucleotide
tatggtgcgttctgcagcgatgg

SEQ ID NO: 2091 - DNA, 119 bp, Artificial Sequence
  Description of Artificial Sequence: Synthetic polynucleotide
attctaatacgactcactataggtatggtgcgttctgcagcgagttttagagctagaaatagcaagttaaaataaggctagtccgttatcaacttgaaaaagtggcaccgagtcggtgc

SEQ ID NO: 2092 - DNA, 21 bp, Homo sapiens
ggtgcgttctacagcgatggc

SEQ ID NO: 2093 - DNA, 21 bp, Artificial Sequence
  Description of Artificial Sequence: Synthetic oligonucleotide
ggtgcgttctgcagcgatggc

SEQ ID NO: 2094 - DNA, 23 bp, Artificial Sequence
  Description of Artificial Sequence: Synthetic oligonucleotide
gctccgagcccgagcggcagcgg

SEQ ID NO: 2095 - DNA, 119 bp, Artificial Sequence
  Description of Artificial Sequence: Synthetic polynucleotide
attctaatacgactcactatagggctccgagcccgagcggcaggttttagagctagaaatagcaagttaaaataaggctagtccgttatcaacttgaaaaagtggcaccgagtcggtgc

SEQ ID NO: 2096 - DNA, 21 bp, Homo sapiens
cccgagcggcggcggcggctc

SEQ ID NO: 2097 - DNA, 21 bp, Artificial Sequence
  Description of Artificial Sequence: Synthetic oligonucleotide
cccgagcggcagcggcggctc

SEQ ID NO: 2098 - DNA, 23 bp, Artificial Sequence
  Description of Artificial Sequence: Synthetic oligonucleotide
ccgagcccgagcggcagcggcgg

SEQ ID NO: 2099 - DNA, 119 bp, Artificial Sequence
  Description of Artificial Sequence: Synthetic polynucleotide
attctaatacgactcactataggccgagcccgagcggcagcgggttttagagctagaaatagcaagttaaaataaggctagtccgttatcaacttgaaaaagtggcaccgagtcggtgc

SEQ ID NO: 2100 - DNA, 23 bp, Artificial Sequence
  Description of Artificial Sequence: Synthetic oligonucleotide
ccgagcggcagcggcggctccgg

SEQ ID NO: 2101 - DNA, 119 bp, Artificial Sequence
  Description of Artificial Sequence: Synthetic polynucleotide
attctaatacgactcactataggccgagcggcagcggcggctcgttttagagctagaaatagcaagttaaaataaggctagtccgttatcaacttgaaaaagtggcaccgagtcggtgc

SEQ ID NO: 2102 - DNA, 23 bp, Artificial Sequence
  Description of Artificial Sequence: Synthetic oligonucleotide
ggcagcggcggctccgggggcgg

SEQ ID NO: 2103 - DNA, 119 bp, Artificial Sequence
  Description of Artificial Sequence: Synthetic polynucleotide
attctaatacgactcactataggggcagcggcggctccggggggttttagagctagaaatagcaagttaaaataaggctagtccgttatcaacttgaaaaagtggcaccgagtcggtgc

SEQ ID NO: 2104 - DNA, 23 bp, Artificial Sequence
  Description of Artificial Sequence: Synthetic oligonucleotide
cgagcggcagcggcggctccggg

SEQ ID NO: 2105 - DNA, 119 bp, Artificial Sequence
  Description of Artificial Sequence: Synthetic polynucleotide
attctaatacgactcactataggcgagcggcagcggcggctccgttttagagctagaaatagcaagttaaaataaggctagtccgttatcaacttgaaaaagtggcaccgagtcggtgc

SEQ ID NO: 2106 - DNA, 23 bp, Artificial Sequence
  Description of Artificial Sequence: Synthetic oligonucleotide
gagcggcagcggcggctccgggg

SEQ ID NO: 2107 - DNA, 119 bp, Artificial Sequence
  Description of Artificial Sequence: Synthetic polynucleotide
attctaatacgactcactatagggagcggcagcggcggctccggttttagagctagaaatagcaagttaaaataaggctagtccgttatcaacttgaaaaagtggcaccgagtcggtgc

SEQ ID NO: 2108 - DNA, 23 bp, Artificial Sequence
  Description of Artificial Sequence: Synthetic oligonucleotide
agcggcagcggcggctccggggg

SEQ ID NO: 2109 - DNA, 119 bp, Artificial Sequence
  Description of Artificial Sequence: Synthetic polynucleotide
attctaatacgactcactataggagcggcagcggcggctccgggttttagagctagaaatagcaagttaaaataaggctagtccgttatcaacttgaaaaagtggcaccgagtcggtgc

SEQ ID NO: 2110 - DNA, 23 bp, Artificial Sequence
  Description of Artificial Sequence: Synthetic oligonucleotide
ccggagccgccgctgccgctcgg

SEQ ID NO: 2111 - DNA, 119 bp, Artificial Sequence
  Description of Artificial Sequence: Synthetic polynucleotide
attctaatacgactcactataggccggagccgccgctgccgctgttttagagctagaaatagcaagttaaaataaggctagtccgttatcaacttgaaaaagtggcaccgagtcggtgc

SEQ ID NO: 2112 - DNA, 23 bp, Artificial Sequence
  Description of Artificial Sequence: Synthetic oligonucleotide
ccgccgctgccgctcgggctcgg

SEQ ID NO: 2113 - DNA, 119 bp, Artificial Sequence
  Description of Artificial Sequence: Synthetic polynucleotide
attctaatacgactcactataggccgccgctgccgctcgggctgttttagagctagaaatagcaagttaaaataaggctagtccgttatcaacttgaaaaagtggcaccgagtcggtgc

SEQ ID NO: 2114 - DNA, 23 bp, Artificial Sequence
  Description of Artificial Sequence: Synthetic oligonucleotide
cggagccgccgctgccgctcggg

SEQ ID NO: 2115 - DNA, 119 bp, Artificial Sequence
  Description of Artificial Sequence: Synthetic polynucleotide
attctaatacgactcactataggcggagccgccgctgccgctcgttttagagctagaaatagcaagttaaaataaggctagtccgttatcaacttgaaaaagtggcaccgagtcggtgc

SEQ ID NO: 2116 - DNA, 23 bp, Artificial Sequence
  Description of Artificial Sequence: Synthetic oligonucleotide
cgcgaagaaaagcagccttgcgg

SEQ ID NO: 2117 - DNA, 119 bp, Artificial Sequence
  Description of Artificial Sequence: Synthetic polynucleotide
attctaatacgactcactataggcgcgaagaaaagcagccttggttttagagctagaaatagcaagttaaaataaggctagtccgttatcaacttgaaaaagtggcaccgagtcggtgc

SEQ ID NO: 2118 - DNA, 21 bp, Homo sapiens
aaagcagcctcgcgggggtcg

SEQ ID NO: 2119 - DNA, 21 bp, Artificial Sequence
  Description of Artificial Sequence: Synthetic oligonucleotide
aaagcagccttgcgggggtcg

SEQ ID NO: 2120 - DNA, 23 bp, Artificial Sequence
  Description of Artificial Sequence: Synthetic oligonucleotide
aagcagccttgcgggggtcgcgg

SEQ ID NO: 2121 - DNA, 119 bp, Artificial Sequence
  Description of Artificial Sequence: Synthetic polynucleotide
attctaatacgactcactataggaagcagccttgcgggggtcggttttagagctagaaatagcaagttaaaataaggctagtccgttatcaacttgaaaaagtggcaccgagtcggtgc

SEQ ID NO: 2122 - DNA, 23 bp, Artificial Sequence
  Description of Artificial Sequence: Synthetic oligonucleotide
tgcgggggtcgcggtgacgtcgg

SEQ ID NO: 2123 - DNA, 119 bp, Artificial Sequence
  Description of Artificial Sequence: Synthetic polynucleotide
attctaatacgactcactataggtgcgggggtcgcggtgacgtgttttagagctagaaatagcaagttaaaataaggctagtccgttatcaacttgaaaaagtggcaccgagtcggtgc

SEQ ID NO: 2124 - DNA, 23 bp, Artificial Sequence
  Description of Artificial Sequence: Synthetic oligonucleotide
gcgaagaaaagcagccttgcggg

SEQ ID NO: 2125 - DNA, 119 bp, Artificial Sequence
  Description of Artificial Sequence: Synthetic polynucleotide
attctaatacgactcactatagggcgaagaaaagcagccttgcgttttagagctagaaatagcaagttaaaataaggctagtccgttatcaacttgaaaaagtggcaccgagtcggtgc

SEQ ID NO: 2126 - DNA, 23 bp, Artificial Sequence
  Description of Artificial Sequence: Synthetic oligonucleotide
cgaagaaaagcagccttgcgggg

SEQ ID NO: 2127 - DNA, 119 bp, Artificial Sequence
  Description of Artificial Sequence: Synthetic polynucleotide
attctaatacgactcactataggcgaagaaaagcagccttgcggttttagagctagaaatagcaagttaaaataaggctagtccgttatcaacttgaaaaagtggcaccgagtcggtgc

SEQ ID NO: 2128 - DNA, 23 bp, Artificial Sequence
  Description of Artificial Sequence: Synthetic oligonucleotide
gaagaaaagcagccttgcggggg

SEQ ID NO: 2129 - DNA, 119 bp, Artificial Sequence
  Description of Artificial Sequence: Synthetic polynucleotide
attctaatacgactcactatagggaagaaaagcagccttgcgggttttagagctagaaatagcaagttaaaataaggctagtccgttatcaacttgaaaaagtggcaccgagtcggtgc

SEQ ID NO: 2130 - DNA, 23 bp, Artificial Sequence
  Description of Artificial Sequence: Synthetic oligonucleotide
acgtcaccgcgacccccgcaagg

SEQ ID NO: 2131 - DNA, 119 bp, Artificial Sequence
  Description of Artificial Sequence: Synthetic polynucleotide
attctaatacgactcactataggacgtcaccgcgacccccgcagttttagagctagaaatagcaagttaaaataaggctagtccgttatcaacttgaaaaagtggcaccgagtcggtgc

SEQ ID NO: 2132 - DNA, 23 bp, Artificial Sequence
  Description of Artificial Sequence: Synthetic oligonucleotide
ccctatgtctcgccgggccgagg

SEQ ID NO: 2133 - DNA, 119 bp, Artificial Sequence
  Description of Artificial Sequence: Synthetic polynucleotide
attctaatacgactcactataggccctatgtctcgccgggccggttttagagctagaaatagcaagttaaaataaggctagtccgttatcaacttgaaaaagtggcaccgagtcggtgc

SEQ ID NO: 2134 - DNA, 21 bp, Homo sapiens
ctccccctatctctcgccggg

SEQ ID NO: 2135 - DNA, 21 bp, Artificial Sequence
  Description of Artificial Sequence: Synthetic oligonucleotide
ctccccctatgtctcgccggg

SEQ ID NO: 2136 - DNA, 23 bp, Artificial Sequence
  Description of Artificial Sequence: Synthetic oligonucleotide
cccctccccctatgtctcgccgg

SEQ ID NO: 2137 - DNA, 119 bp, Artificial Sequence
  Description of Artificial Sequence: Synthetic polynucleotide
attctaatacgactcactataggcccctccccctatgtctcgcgttttagagctagaaatagcaagttaaaataaggctagtccgttatcaacttgaaaaagtggcaccgagtcggtgc

SEQ ID NO: 2138 - DNA, 23 bp, Artificial Sequence
  Description of Artificial Sequence: Synthetic oligonucleotide
ccctccccctatgtctcgccggg

SEQ ID NO: 2139 - DNA, 119 bp, Artificial Sequence
  Description of Artificial Sequence: Synthetic polynucleotide
attctaatacgactcactataggccctccccctatgtctcgccgttttagagctagaaatagcaagttaaaataaggctagtccgttatcaacttgaaaaagtggcaccgagtcggtgc

SEQ ID NO: 2140 - DNA, 23 bp, Artificial Sequence
  Description of Artificial Sequence: Synthetic oligonucleotide
gcctcggcccggcgagacatagg

SEQ ID NO: 2141 - DNA, 119 bp, Artificial Sequence
  Description of Artificial Sequence: Synthetic polynucleotide
attctaatacgactcactatagggcctcggcccggcgagacatgttttagagctagaaatagcaagttaaaataaggctagtccgttatcaacttgaaaaagtggcaccgagtcggtgc

SEQ ID NO: 2142 - DNA, 23 bp, Artificial Sequence
  Description of Artificial Sequence: Synthetic oligonucleotide
gcccggcgagacatagggggagg

SEQ ID NO: 2143 - DNA, 119 bp, Artificial Sequence
  Description of Artificial Sequence: Synthetic polynucleotide
attctaatacgactcactatagggcccggcgagacataggggggttttagagctagaaatagcaagttaaaataaggctagtccgttatcaacttgaaaaagtggcaccgagtcggtgc

SEQ ID NO: 2144 - DNA, 23 bp, Artificial Sequence
  Description of Artificial Sequence: Synthetic oligonucleotide
gcgagacatagggggaggggagg

SEQ ID NO: 2145 - DNA, 119 bp, Artificial Sequence
  Description of Artificial Sequence: Synthetic polynucleotide
attctaatacgactcactatagggcgagacatagggggagggggttttagagctagaaatagcaagttaaaataaggctagtccgttatcaacttgaaaaagtggcaccgagtcggtgc

SEQ ID NO: 2146 - DNA, 23 bp, Artificial Sequence
  Description of Artificial Sequence: Synthetic oligonucleotide
gacatagggggaggggaggccgg

SEQ ID NO: 2147 - DNA, 119 bp, Artificial Sequence
  Description of Artificial Sequence: Synthetic polynucleotide
attctaatacgactcactatagggacatagggggaggggaggcgttttagagctagaaatagcaagttaaaataaggctagtccgttatcaacttgaaaaagtggcaccgagtcggtgc

SEQ ID NO: 2148 - DNA, 23 bp, Artificial Sequence
  Description of Artificial Sequence: Synthetic oligonucleotide
cctcggcccggcgagacataggg

SEQ ID NO: 2149 - DNA, 119 bp, Artificial Sequence
  Description of Artificial Sequence: Synthetic polynucleotide
attctaatacgactcactataggcctcggcccggcgagacatagttttagagctagaaatagcaagttaaaataaggctagtccgttatcaacttgaaaaagtggcaccgagtcggtgc

SEQ ID NO: 2150 - DNA, 23 bp, Artificial Sequence
  Description of Artificial Sequence: Synthetic oligonucleotide
ctcggcccggcgagacatagggg

SEQ ID NO: 2151 - DNA, 119 bp, Artificial Sequence
  Description of Artificial Sequence: Synthetic polynucleotide
attctaatacgactcactataggctcggcccggcgagacataggttttagagctagaaatagcaagttaaaataaggctagtccgttatcaacttgaaaaagtggcaccgagtcggtgc

SEQ ID NO: 2152 - DNA, 23 bp, Artificial Sequence
  Description of Artificial Sequence: Synthetic oligonucleotide
tcggcccggcgagacataggggg

SEQ ID NO: 2153 - DNA, 119 bp, Artificial Sequence
  Description of Artificial Sequence: Synthetic polynucleotide
attctaatacgactcactataggtcggcccggcgagacatagggttttagagctagaaatagcaagttaaaataaggctagtccgttatcaacttgaaaaagtggcaccgagtcggtgc

SEQ ID NO: 2154 - DNA, 23 bp, Artificial Sequence
  Description of Artificial Sequence: Synthetic oligonucleotide
cccggcgagacatagggggaggg

SEQ ID NO: 2155 - DNA, 119 bp, Artificial Sequence
  Description of Artificial Sequence: Synthetic polynucleotide
attctaatacgactcactataggcccggcgagacatagggggagttttagagctagaaatagcaagttaaaataaggctagtccgttatcaacttgaaaaagtggcaccgagtcggtgc

SEQ ID NO: 2156 - DNA, 23 bp, Artificial Sequence
  Description of Artificial Sequence: Synthetic oligonucleotide
ccggcgagacatagggggagggg

SEQ ID NO: 2157 - DNA, 119 bp, Artificial Sequence
  Description of Artificial Sequence: Synthetic polynucleotide
attctaatacgactcactataggccggcgagacatagggggaggttttagagctagaaatagcaagttaaaataaggctagtccgttatcaacttgaaaaagtggcaccgagtcggtgc

SEQ ID NO: 2158 - DNA, 23 bp, Artificial Sequence
  Description of Artificial Sequence: Synthetic oligonucleotide
gcgccttcgccaacagctccagg

SEQ ID NO: 2159 - DNA, 119 bp, Artificial Sequence
  Description of Artificial Sequence: Synthetic polynucleotide
attctaatacgactcactatagggcgccttcgccaacagctccgttttagagctagaaatagcaagttaaaataaggctagtccgttatcaacttgaaaaagtggcaccgagtcggtgc

SEQ ID NO: 2160 - DNA, 30 bp, Homo sapiens
ggcaaagatagtgagaggggcagtagggag

SEQ ID NO: 2161 - DNA, 50 bp, Homo sapiens
aacagctccaggcaaagatagtgagaggggcagtagggagggctgtcagg

SEQ ID NO: 2162 - DNA, 20 bp, Artificial Sequence
  Description of Artificial Sequence: Synthetic oligonucleotide
aacagctccaggctgtcagg

SEQ ID NO: 2163 - DNA, 23 bp, Artificial Sequence
  Description of Artificial Sequence: Synthetic oligonucleotide
gccaacagctccaggctgtcagg

SEQ ID NO: 2164 - DNA, 119 bp, Artificial Sequence
  Description of Artificial Sequence: Synthetic polynucleotide
attctaatacgactcactatagggccaacagctccaggctgtcgttttagagctagaaatagcaagttaaaataaggctagtccgttatcaacttgaaaaagtggcaccgagtcggtgc

SEQ ID NO: 2165 - DNA, 23 bp, Artificial Sequence
  Description of Artificial Sequence: Synthetic oligonucleotide
agctccaggctgtcagggagagg

SEQ ID NO: 2166 - DNA, 119 bp, Artificial Sequence
  Description of Artificial Sequence: Synthetic polynucleotide
attctaatacgactcactataggagctccaggctgtcagggaggttttagagctagaaatagcaagttaaaataaggctagtccgttatcaacttgaaaaagtggcaccgagtcggtgc

SEQ ID NO: 2167 - DNA, 23 bp, Artificial Sequence
  Description of Artificial Sequence: Synthetic oligonucleotide
ccaacagctccaggctgtcaggg

SEQ ID NO: 2168 - DNA, 119 bp, Artificial Sequence
  Description of Artificial Sequence: Synthetic polynucleotide
attctaatacgactcactataggccaacagctccaggctgtcagttttagagctagaaatagcaagttaaaataaggctagtccgttatcaacttgaaaaagtggcaccgagtcggtgc

SEQ ID NO: 2169 - DNA, 23 bp, Artificial Sequence
  Description of Artificial Sequence: Synthetic oligonucleotide
gctccaggctgtcagggagaggg

SEQ ID NO: 2170 - DNA, 119 bp, Artificial Sequence
  Description of Artificial Sequence: Synthetic polynucleotide
attctaatacgactcactatagggctccaggctgtcagggagagttttagagctagaaatagcaagttaaaataaggctagtccgttatcaacttgaaaaagtggcaccgagtcggtgc

SEQ ID NO: 2171 - DNA, 23 bp, Artificial Sequence
  Description of Artificial Sequence: Synthetic oligonucleotide
ctccaggctgtcagggagagggg

SEQ ID NO: 2172 - DNA, 119 bp, Artificial Sequence
  Description of Artificial Sequence: Synthetic polynucleotide
attctaatacgactcactataggctccaggctgtcagggagaggttttagagctagaaatagcaagttaaaataaggctagtccgttatcaacttgaaaaagtggcaccgagtcggtgc

SEQ ID NO: 2173 - DNA, 23 bp, Artificial Sequence
  Description of Artificial Sequence: Synthetic oligonucleotide
cagcctggagctgttggcgaagg

SEQ ID NO: 2174 - DNA, 119 bp, Artificial Sequence
  Description of Artificial Sequence: Synthetic polynucleotide
attctaatacgactcactataggcagcctggagctgttggcgagttttagagctagaaatagcaagttaaaataaggctagtccgttatcaacttgaaaaagtggcaccgagtcggtgc

SEQ ID NO: 2175 - DNA, 23 bp, Artificial Sequence
  Description of Artificial Sequence: Synthetic oligonucleotide
agcccctctccctgacagcctgg

SEQ ID NO: 2176 - DNA, 119 bp, Artificial Sequence
  Description of Artificial Sequence: Synthetic polynucleotide
attctaatacgactcactataggagcccctctccctgacagccgttttagagctagaaatagcaagttaaaataaggctagtccgttatcaacttgaaaaagtggcaccgagtcggtgc

SEQ ID NO: 2177 - DNA, 23 bp, Artificial Sequence
  Description of Artificial Sequence: Synthetic oligonucleotide
ccctgacagcctggagctgttgg

SEQ ID NO: 2178 - DNA, 119 bp, Artificial Sequence
  Description of Artificial Sequence: Synthetic polynucleotide
attctaatacgactcactataggccctgacagcctggagctgtgttttagagctagaaatagcaagttaaaataaggctagtccgttatcaacttgaaaaagtggcaccgagtcggtgc

SEQ ID NO: 2179 - DNA, 23 bp, Artificial Sequence
  Description of Artificial Sequence: Synthetic oligonucleotide
agaaatcagtccccataatgtgg

SEQ ID NO: 2180 - DNA, 119 bp, Artificial Sequence
  Description of Artificial Sequence: Synthetic polynucleotide
attctaatacgactcactataggagaaatcagtccccataatggttttagagctagaaatagcaagttaaaataaggctagtccgttatcaacttgaaaaagtggcaccgagtcggtgc

SEQ ID NO: 2181 - DNA, 23 bp, Artificial Sequence
  Description of Artificial Sequence: Synthetic oligonucleotide
gcacattaacatccacattatgg

SEQ ID NO: 2182 - DNA, 119 bp, Artificial Sequence
  Description of Artificial Sequence: Synthetic polynucleotide
attctaatacgactcactatagggcacattaacatccacattagttttagagctagaaatagcaagttaaaataaggctagtccgttatcaacttgaaaaagtggcaccgagtcggtgc

SEQ ID NO: 2183 - DNA, 23 bp, Artificial Sequence
  Description of Artificial Sequence: Synthetic oligonucleotide
cacattaacatccacattatggg

SEQ ID NO: 2184 - DNA, 119 bp, Artificial Sequence
  Description of Artificial Sequence: Synthetic polynucleotide
attctaatacgactcactataggcacattaacatccacattatgttttagagctagaaatagcaagttaaaataaggctagtccgttatcaacttgaaaaagtggcaccgagtcggtgc

SEQ ID NO: 2185 - DNA, 23 bp, Artificial Sequence
  Description of Artificial Sequence: Synthetic oligonucleotide
acattaacatccacattatgggg

SEQ ID NO: 2186 - DNA, 119 bp, Artificial Sequence
  Description of Artificial Sequence: Synthetic polynucleotide
attctaatacgactcactataggacattaacatccacattatggttttagagctagaaatagcaagttaaaataaggctagtccgttatcaacttgaaaaagtggcaccgagtcggtgc

SEQ ID NO: 2187 - DNA, 23 bp, Artificial Sequence
  Description of Artificial Sequence: Synthetic oligonucleotide
tcctgggctccaattcctcgagg

SEQ ID NO: 2188 - DNA, 119 bp, Artificial Sequence
  Description of Artificial Sequence: Synthetic polynucleotide
attctaatacgactcactataggtcctgggctccaattcctcggttttagagctagaaatagcaagttaaaataaggctagtccgttatcaacttgaaaaagtggcaccgagtcggtgc

SEQ ID NO: 2189 - DNA, 21 bp, Homo sapiens
ccaattcctccaggatgtact

SEQ ID NO: 2190 - DNA, 21 bp, Artificial Sequence
  Description of Artificial Sequence: Synthetic oligonucleotide
ccaattcctcgaggatgtact

SEQ ID NO: 2191 - DNA, 23 bp, Artificial Sequence
  Description of Artificial Sequence: Synthetic oligonucleotide
ctcgaggatgtacttcacccagg

SEQ ID NO: 2192 - DNA, 119 bp, Artificial Sequence
  Description of Artificial Sequence: Synthetic polynucleotide
attctaatacgactcactataggctcgaggatgtacttcacccgttttagagctagaaatagcaagttaaaataaggctagtccgttatcaacttgaaaaagtggcaccgagtcggtgc

SEQ ID NO: 2193 - DNA, 23 bp, Artificial Sequence
  Description of Artificial Sequence: Synthetic oligonucleotide
ctgggtgaagtacatcctcgagg

SEQ ID NO: 2194 - DNA, 119 bp, Artificial Sequence
  Description of Artificial Sequence: Synthetic polynucleotide
attctaatacgactcactataggctgggtgaagtacatcctcggttttagagctagaaatagcaagttaaaataaggctagtccgttatcaacttgaaaaagtggcaccgagtcggtgc

SEQ ID NO: 2195 - DNA, 23 bp, Artificial Sequence
  Description of Artificial Sequence: Synthetic oligonucleotide
tcctcgaggaattggagcccagg

SEQ ID NO: 2196 - DNA, 119 bp, Artificial Sequence
  Description of Artificial Sequence: Synthetic polynucleotide
attctaatacgactcactataggtcctcgaggaattggagcccgttttagagctagaaatagcaagttaaaataaggctagtccgttatcaacttgaaaaagtggcaccgagtcggtgc

SEQ ID NO: 2197 - DNA, 23 bp, Artificial Sequence
  Description of Artificial Sequence: Synthetic oligonucleotide
gaagtacatcctcgaggaattgg

SEQ ID NO: 2198 - DNA, 119 bp, Artificial Sequence
  Description of Artificial Sequence: Synthetic polynucleotide
attctaatacgactcactatagggaagtacatcctcgaggaatgttttagagctagaaatagcaagttaaaataaggctagtccgttatcaacttgaaaaagtggcaccgagtcggtgc

SEQ ID NO: 2199 - DNA, 23 bp, Artificial Sequence
  Description of Artificial Sequence: Synthetic oligonucleotide
gcgctctgcgtcaccgcccaagg

SEQ ID NO: 2200 - DNA, 119 bp, Artificial Sequence
  Description of Artificial Sequence: Synthetic polynucleotide
attctaatacgactcactatagggcgctctgcgtcaccgcccagttttagagctagaaatagcaagttaaaataaggctagtccgttatcaacttgaaaaagtggcaccgagtcggtgc

SEQ ID NO: 2201 - DNA, 21 bp, Homo sapiens
tggcgcgctccgcgtcaccgc

SEQ ID NO: 2202 - DNA, 21 bp, Artificial Sequence
  Description of Artificial Sequence: Synthetic oligonucleotide
tggcgcgctctgcgtcaccgc

SEQ ID NO: 2203 - DNA, 23 bp, Artificial Sequence
  Description of Artificial Sequence: Synthetic oligonucleotide
cggtgacgcagagcgcgccaagg

SEQ ID NO: 2204 - DNA, 119 bp, Artificial Sequence
  Description of Artificial Sequence: Synthetic polynucleotide
attctaatacgactcactataggcggtgacgcagagcgcgccagttttagagctagaaatagcaagttaaaataaggctagtccgttatcaacttgaaaaagtggcaccgagtcggtgc

SEQ ID NO: 2205 - DNA, 23 bp, Artificial Sequence
  Description of Artificial Sequence: Synthetic oligonucleotide
cgcagagcgcgccaagggcctgg

SEQ ID NO: 2206 - DNA, 119 bp, Artificial Sequence
  Description of Artificial Sequence: Synthetic polynucleotide
attctaatacgactcactataggcgcagagcgcgccaagggccgttttagagctagaaatagcaagttaaaataaggctagtccgttatcaacttgaaaaagtggcaccgagtcggtgc

SEQ ID NO: 2207 - DNA, 23 bp, Artificial Sequence
  Description of Artificial Sequence: Synthetic oligonucleotide
ggtgacgcagagcgcgccaaggg

SEQ ID NO: 2208 - DNA, 119 bp, Artificial Sequence
  Description of Artificial Sequence: Synthetic polynucleotide
attctaatacgactcactataggggtgacgcagagcgcgccaagttttagagctagaaatagcaagttaaaataaggctagtccgttatcaacttgaaaaagtggcaccgagtcggtgc

SEQ ID NO: 2209 - DNA, 23 bp, Artificial Sequence
  Description of Artificial Sequence: Synthetic oligonucleotide
gcagagcgcgccaagggcctggg

SEQ ID NO: 2210 - DNA, 119 bp, Artificial Sequence
  Description of Artificial Sequence: Synthetic polynucleotide
attctaatacgactcactatagggcagagcgcgccaagggcctgttttagagctagaaatagcaagttaaaataaggctagtccgttatcaacttgaaaaagtggcaccgagtcggtgc

SEQ ID NO: 2211 - DNA, 23 bp, Artificial Sequence
  Description of Artificial Sequence: Synthetic oligonucleotide
gggtgggctgtgagatcaccagg

SEQ ID NO: 2212 - DNA, 119 bp, Artificial Sequence
  Description of Artificial Sequence: Synthetic polynucleotide
attctaatacgactcactatagggggtgggctgtgagatcaccgttttagagctagaaatagcaagttaaaataaggctagtccgttatcaacttgaaaaagtggcaccgagtcggtgc

SEQ ID NO: 2213 - DNA, 23 bp, Artificial Sequence
  Description of Artificial Sequence: Synthetic oligonucleotide
ctgtgagatcaccaggccaaagg

SEQ ID NO: 2214 - DNA, 119 bp, Artificial Sequence
  Description of Artificial Sequence: Synthetic polynucleotide
attctaatacgactcactataggctgtgagatcaccaggccaagttttagagctagaaatagcaagttaaaataaggctagtccgttatcaacttgaaaaagtggcaccgagtcggtgc

SEQ ID NO: 2215 - DNA, 23 bp, Artificial Sequence
  Description of Artificial Sequence: Synthetic oligonucleotide
caccaggccaaaggcgatagagg

SEQ ID NO: 2216 - DNA, 119 bp, Artificial Sequence
  Description of Artificial Sequence: Synthetic polynucleotide
attctaatacgactcactataggcaccaggccaaaggcgataggttttagagctagaaatagcaagttaaaataaggctagtccgttatcaacttgaaaaagtggcaccgagtcggtgc

SEQ ID NO: 2217 - DNA, 23 bp, Artificial Sequence
  Description of Artificial Sequence: Synthetic oligonucleotide
tgcctctatcgcctttggcctgg

SEQ ID NO: 2218 - DNA, 119 bp, Artificial Sequence
  Description of Artificial Sequence: Synthetic polynucleotide
attctaatacgactcactataggtgcctctatcgcctttggccgttttagagctagaaatagcaagttaaaataaggctagtccgttatcaacttgaaaaagtggcaccgagtcggtgc

SEQ ID NO: 2219 - DNA, 23 bp, Artificial Sequence
  Description of Artificial Sequence: Synthetic oligonucleotide
tgttgatctgtcaggacagcagg

SEQ ID NO: 2220 - DNA, 119 bp, Artificial Sequence
  Description of Artificial Sequence: Synthetic polynucleotide
attctaatacgactcactataggtgttgatctgtcaggacagcgttttagagctagaaatagcaagttaaaataaggctagtccgttatcaacttgaaaaagtggcaccgagtcggtgc

SEQ ID NO: 2221 - DNA, 23 bp, Artificial Sequence
  Description of Artificial Sequence: Synthetic oligonucleotide
gtgggctcaagctcaacagcagg

SEQ ID NO: 2222 - DNA, 119 bp, Artificial Sequence
  Description of Artificial Sequence: Synthetic polynucleotide
attctaatacgactcactatagggtgggctcaagctcaacagcgttttagagctagaaatagcaagttaaaataaggctagtccgttatcaacttgaaaaagtggcaccgagtcggtgc

SEQ ID NO: 2223 - DNA, 23 bp, Artificial Sequence
  Description of Artificial Sequence: Synthetic oligonucleotide
tgttgagcttgagcccaccacgg

SEQ ID NO: 2224 - DNA, 119 bp, Artificial Sequence
  Description of Artificial Sequence: Synthetic polynucleotide
attctaatacgactcactataggtgttgagcttgagcccaccagttttagagctagaaatagcaagttaaaataaggctagtccgttatcaacttgaaaaagtggcaccgagtcggtgc

SEQ ID NO: 2225 - DNA, 23 bp, Artificial Sequence
  Description of Artificial Sequence: Synthetic oligonucleotide
ctgctcacaggcaaggtgtaagg

SEQ ID NO: 2226 - DNA, 119 bp, Artificial Sequence
  Description of Artificial Sequence: Synthetic polynucleotide
attctaatacgactcactataggctgctcacaggcaaggtgtagttttagagctagaaatagcaagttaaaataaggctagtccgttatcaacttgaaaaagtggcaccgagtcggtgc

SEQ ID NO: 2227 - DNA, 23 bp, Artificial Sequence
  Description of Artificial Sequence: Synthetic oligonucleotide
tgctcacaggcaaggtgtaaggg

SEQ ID NO: 2228 - DNA, 119 bp, Artificial Sequence
  Description of Artificial Sequence: Synthetic polynucleotide
attctaatacgactcactataggtgctcacaggcaaggtgtaagttttagagctagaaatagcaagttaaaataaggctagtccgttatcaacttgaaaaagtggcaccgagtcggtgc

SEQ ID NO: 2229 - DNA, 23 bp, Artificial Sequence
  Description of Artificial Sequence: Synthetic oligonucleotide
gctcacaggcaaggtgtaagggg

SEQ ID NO: 2230 - DNA, 119 bp, Artificial Sequence
  Description of Artificial Sequence: Synthetic polynucleotide
attctaatacgactcactatagggctcacaggcaaggtgtaaggttttagagctagaaatagcaagttaaaataaggctagtccgttatcaacttgaaaaagtggcaccgagtcggtgc

SEQ ID NO: 2231 - DNA, 23 bp, Artificial Sequence
  Description of Artificial Sequence: Synthetic oligonucleotide
ctcacaggcaaggtgtaaggggg

SEQ ID NO: 2232 - DNA, 119 bp, Artificial Sequence
  Description of Artificial Sequence: Synthetic polynucleotide
attctaatacgactcactataggctcacaggcaaggtgtaagggttttagagctagaaatagcaagttaaaataaggctagtccgttatcaacttgaaaaagtggcaccgagtcggtgc

SEQ ID NO: 2233 - DNA, 23 bp, Artificial Sequence
  Description of Artificial Sequence: Synthetic oligonucleotide
cttacaccttgcctgtgagcagg

SEQ ID NO: 2234 - DNA, 119 bp, Artificial Sequence
  Description of Artificial Sequence: Synthetic polynucleotide
attctaatacgactcactataggcttacaccttgcctgtgagcgttttagagctagaaatagcaagttaaaataaggctagtccgttatcaacttgaaaaagtggcaccgagtcggtgc

SEQ ID NO: 2235 - DNA, 23 bp, Artificial Sequence
  Description of Artificial Sequence: Synthetic oligonucleotide
ttacaccttgcctgtgagcaggg

SEQ ID NO: 2236 - DNA, 119 bp, Artificial Sequence
  Description of Artificial Sequence: Synthetic polynucleotide
attctaatacgactcactataggttacaccttgcctgtgagcagttttagagctagaaatagcaagttaaaataaggctagtccgttatcaacttgaaaaagtggcaccgagtcggtgc

SEQ ID NO: 2237 - DNA, 23 bp, Artificial Sequence
  Description of Artificial Sequence: Synthetic oligonucleotide
cgtcgtgccatcatgcatgcagg

SEQ ID NO: 2238 - DNA, 119 bp, Artificial Sequence
  Description of Artificial Sequence: Synthetic polynucleotide
attctaatacgactcactataggcgtcgtgccatcatgcatgcgttttagagctagaaatagcaagttaaaataaggctagtccgttatcaacttgaaaaagtggcaccgagtcggtgc

SEQ ID NO: 2239 - DNA, 21 bp, Homo sapiens
tcatgcatgcgggcatccagg

SEQ ID NO: 2240 - DNA, 21 bp, Artificial Sequence
  Description of Artificial Sequence: Synthetic oligonucleotide
tcatgcatgcaggcatccagg

SEQ ID NO: 2241 - DNA, 23 bp, Artificial Sequence
  Description of Artificial Sequence: Synthetic oligonucleotide
catcatgcatgcaggcatccagg

SEQ ID NO: 2242 - DNA, 119 bp, Artificial Sequence
  Description of Artificial Sequence: Synthetic polynucleotide
attctaatacgactcactataggcatcatgcatgcaggcatccgttttagagctagaaatagcaagttaaaataaggctagtccgttatcaacttgaaaaagtggcaccgagtcggtgc

SEQ ID NO: 2243 - DNA, 23 bp, Artificial Sequence
  Description of Artificial Sequence: Synthetic oligonucleotide
catgcaggcatccaggtctgtgg

SEQ ID NO: 2244 - DNA, 119 bp, Artificial Sequence
  Description of Artificial Sequence: Synthetic polynucleotide
attctaatacgactcactataggcatgcaggcatccaggtctggttttagagctagaaatagcaagttaaaataaggctagtccgttatcaacttgaaaaagtggcaccgagtcggtgc

SEQ ID NO: 2245 - DNA, 23 bp, Artificial Sequence
  Description of Artificial Sequence: Synthetic oligonucleotide
aggcatccaggtctgtggctcgg

SEQ ID NO: 2246 - DNA, 119 bp, Artificial Sequence
  Description of Artificial Sequence: Synthetic polynucleotide
attctaatacgactcactataggaggcatccaggtctgtggctgttttagagctagaaatagcaagttaaaataaggctagtccgttatcaacttgaaaaagtggcaccgagtcggtgc

SEQ ID NO: 2247 - DNA, 23 bp, Artificial Sequence
  Description of Artificial Sequence: Synthetic oligonucleotide
ctggatgcctgcatgcatgatgg

SEQ ID NO: 2248 - DNA, 119 bp, Artificial Sequence
  Description of Artificial Sequence: Synthetic polynucleotide
attctaatacgactcactataggctggatgcctgcatgcatgagttttagagctagaaatagcaagttaaaataaggctagtccgttatcaacttgaaaaagtggcaccgagtcggtgc

SEQ ID NO: 2249 - DNA, 23 bp, Artificial Sequence
  Description of Artificial Sequence: Synthetic oligonucleotide
caggtgccgccatgcaggcaagg

SEQ ID NO: 2250 - DNA, 119 bp, Artificial Sequence
  Description of Artificial Sequence: Synthetic polynucleotide
attctaatacgactcactataggcaggtgccgccatgcaggcagttttagagctagaaatagcaagttaaaataaggctagtccgttatcaacttgaaaaagtggcaccgagtcggtgc

SEQ ID NO: 2251 - DNA, 21 bp, Homo sapiens
catgcaggcagggctgtgagt

SEQ ID NO: 2252 - DNA, 21 bp, Artificial Sequence
  Description of Artificial Sequence: Synthetic oligonucleotide
catgcaggcaaggctgtgagt

SEQ ID NO: 2253 - DNA, 23 bp, Artificial Sequence
  Description of Artificial Sequence: Synthetic oligonucleotide
gactcacagccttgcctgcatgg

SEQ ID NO: 2254 - DNA, 119 bp, Artificial Sequence
  Description of Artificial Sequence: Synthetic polynucleotide
attctaatacgactcactatagggactcacagccttgcctgcagttttagagctagaaatagcaagttaaaataaggctagtccgttatcaacttgaaaaagtggcaccgagtcggtgc

SEQ ID NO: 2255 - DNA, 23 bp, Artificial Sequence
  Description of Artificial Sequence: Synthetic oligonucleotide
tcacagccttgcctgcatggcgg

SEQ ID NO: 2256 - DNA, 119 bp, Artificial Sequence
  Description of Artificial Sequence: Synthetic polynucleotide
attctaatacgactcactataggtcacagccttgcctgcatgggttttagagctagaaatagcaagttaaaataaggctagtccgttatcaacttgaaaaagtggcaccgagtcggtgc

SEQ ID NO: 2257 - DNA, 23 bp, Artificial Sequence
  Description of Artificial Sequence: Synthetic oligonucleotide
tcattggcccgcctcagcctcgg

SEQ ID NO: 2258 - DNA, 119 bp, Artificial Sequence
  Description of Artificial Sequence: Synthetic polynucleotide
attctaatacgactcactataggtcattggcccgcctcagcctgttttagagctagaaatagcaagttaaaataaggctagtccgttatcaacttgaaaaagtggcaccgagtcggtgc

SEQ ID NO: 2259 - DNA, 21 bp, Homo sapiens
gcccgcctcaccctcggcaca

SEQ ID NO: 2260 - DNA, 21 bp, Artificial Sequence
  Description of Artificial Sequence: Synthetic oligonucleotide
gcccgcctcagcctcggcaca

SEQ ID NO: 2261 - DNA, 23 bp, Artificial Sequence
  Description of Artificial Sequence: Synthetic oligonucleotide
ccgcctcagcctcggcacagcgg

SEQ ID NO: 2262 - DNA, 119 bp, Artificial Sequence
  Description of Artificial Sequence: Synthetic polynucleotide
attctaatacgactcactataggccgcctcagcctcggcacaggttttagagctagaaatagcaagttaaaataaggctagtccgttatcaacttgaaaaagtggcaccgagtcggtgc

SEQ ID NO: 2263 - DNA, 23 bp, Artificial Sequence
  Description of Artificial Sequence: Synthetic oligonucleotide
gtgccgctgtgccgaggctgagg

SEQ ID NO: 2264 - DNA, 119 bp, Artificial Sequence
  Description of Artificial Sequence: Synthetic polynucleotide
attctaatacgactcactatagggtgccgctgtgccgaggctggttttagagctagaaatagcaagttaaaataaggctagtccgttatcaacttgaaaaagtggcaccgagtcggtgc

SEQ ID NO: 2265 - DNA, 23 bp, Artificial Sequence
  Description of Artificial Sequence: Synthetic oligonucleotide
ccgctgtgccgaggctgaggcgg

SEQ ID NO: 2266 - DNA, 119 bp, Artificial Sequence
  Description of Artificial Sequence: Synthetic polynucleotide
attctaatacgactcactataggccgctgtgccgaggctgagggttttagagctagaaatagcaagttaaaataaggctagtccgttatcaacttgaaaaagtggcaccgagtcggtgc

SEQ ID NO: 2267 - DNA, 23 bp, Artificial Sequence
  Description of Artificial Sequence: Synthetic oligonucleotide
cgctgtgccgaggctgaggcggg

SEQ ID NO: 2268 - DNA, 119 bp, Artificial Sequence
  Description of Artificial Sequence: Synthetic polynucleotide
attctaatacgactcactataggcgctgtgccgaggctgaggcgttttagagctagaaatagcaagttaaaataaggctagtccgttatcaacttgaaaaagtggcaccgagtcggtgc

SEQ ID NO: 2269 - DNA, 23 bp, Artificial Sequence
  Description of Artificial Sequence: Synthetic oligonucleotide
tctgaccgtcaaaccctagcagg

SEQ ID NO: 2270 - DNA, 119 bp, Artificial Sequence
  Description of Artificial Sequence: Synthetic polynucleotide
attctaatacgactcactataggtctgaccgtcaaaccctagcgttttagagctagaaatagcaagttaaaataaggctagtccgttatcaacttgaaaaagtggcaccgagtcggtgc

SEQ ID NO: 2271 - DNA, 23 bp, Artificial Sequence
  Description of Artificial Sequence: Synthetic oligonucleotide
ccgtcaaaccctagcagggaagg

SEQ ID NO: 2272 - DNA, 119 bp, Artificial Sequence
  Description of Artificial Sequence: Synthetic polynucleotide
attctaatacgactcactataggccgtcaaaccctagcagggagttttagagctagaaatagcaagttaaaataaggctagtccgttatcaacttgaaaaagtggcaccgagtcggtgc

SEQ ID NO: 2273 - DNA, 23 bp, Artificial Sequence
  Description of Artificial Sequence: Synthetic oligonucleotide
ctgaccgtcaaaccctagcaggg

SEQ ID NO: 2274 - DNA, 119 bp, Artificial Sequence
  Description of Artificial Sequence: Synthetic polynucleotide
attctaatacgactcactataggctgaccgtcaaaccctagcagttttagagctagaaatagcaagttaaaataaggctagtccgttatcaacttgaaaaagtggcaccgagtcggtgc

SEQ ID NO: 2275 - DNA, 23 bp, Artificial Sequence
  Description of Artificial Sequence: Synthetic oligonucleotide
cgtcaaaccctagcagggaaggg

SEQ ID NO: 2276 - DNA, 119 bp, Artificial Sequence
  Description of Artificial Sequence: Synthetic polynucleotide
attctaatacgactcactataggcgtcaaaccctagcagggaagttttagagctagaaatagcaagttaaaataaggctagtccgttatcaacttgaaaaagtggcaccgagtcggtgc

SEQ ID NO: 2277 - DNA, 23 bp, Artificial Sequence
  Description of Artificial Sequence: Synthetic oligonucleotide
gtcaaaccctagcagggaagggg

SEQ ID NO: 2278 - DNA, 119 bp, Artificial Sequence
  Description of Artificial Sequence: Synthetic polynucleotide
attctaatacgactcactatagggtcaaaccctagcagggaaggttttagagctagaaatagcaagttaaaataaggctagtccgttatcaacttgaaaaagtggcaccgagtcggtgc

SEQ ID NO: 2279 - DNA, 23 bp, Artificial Sequence
  Description of Artificial Sequence: Synthetic oligonucleotide
ccttccctgctagggtttgacgg

SEQ ID NO: 2280 - DNA, 119 bp, Artificial Sequence
  Description of Artificial Sequence: Synthetic polynucleotide
attctaatacgactcactataggccttccctgctagggtttgagttttagagctagaaatagcaagttaaaataaggctagtccgttatcaacttgaaaaagtggcaccgagtcggtgc

SEQ ID NO: 2281 - DNA, 23 bp, Artificial Sequence
  Description of Artificial Sequence: Synthetic oligonucleotide
aggcagatgcagcggaagccagg

SEQ ID NO: 2282 - DNA, 119 bp, Artificial Sequence
  Description of Artificial Sequence: Synthetic polynucleotide
attctaatacgactcactataggaggcagatgcagcggaagccgttttagagctagaaatagcaagttaaaataaggctagtccgttatcaacttgaaaaagtggcaccgagtcggtgc

SEQ ID NO: 2283 - DNA, 21 bp, Homo sapiens
ctcgaggcaggtgcagcggaa

SEQ ID NO: 2284 - DNA, 21 bp, Artificial Sequence
  Description of Artificial Sequence: Synthetic oligonucleotide
ctcgaggcagatgcagcggaa

SEQ ID NO: 2285 - DNA, 23 bp, Artificial Sequence
  Description of Artificial Sequence: Synthetic oligonucleotide
agatgcagcggaagccagggtgg

SEQ ID NO: 2286 - DNA, 119 bp, Artificial Sequence
  Description of Artificial Sequence: Synthetic polynucleotide
attctaatacgactcactataggagatgcagcggaagccaggggttttagagctagaaatagcaagttaaaataaggctagtccgttatcaacttgaaaaagtggcaccgagtcggtgc

SEQ ID NO: 2287 - DNA, 23 bp, Artificial Sequence
  Description of Artificial Sequence: Synthetic oligonucleotide
agctctcgaggcagatgcagcgg

SEQ ID NO: 2288 - DNA, 119 bp, Artificial Sequence
  Description of Artificial Sequence: Synthetic polynucleotide
attctaatacgactcactataggagctctcgaggcagatgcaggttttagagctagaaatagcaagttaaaataaggctagtccgttatcaacttgaaaaagtggcaccgagtcggtgc

SEQ ID NO: 2289 - DNA, 23 bp, Artificial Sequence
  Description of Artificial Sequence: Synthetic oligonucleotide
ggcagatgcagcggaagccaggg

SEQ ID NO: 2290 - DNA, 119 bp, Artificial Sequence
  Description of Artificial Sequence: Synthetic polynucleotide
attctaatacgactcactataggggcagatgcagcggaagccagttttagagctagaaatagcaagttaaaataaggctagtccgttatcaacttgaaaaagtggcaccgagtcggtgc

SEQ ID NO: 2291 - DNA, 23 bp, Artificial Sequence
  Description of Artificial Sequence: Synthetic oligonucleotide
gatgcagcggaagccagggtggg

SEQ ID NO: 2292 - DNA, 119 bp, Artificial Sequence
  Description of Artificial Sequence: Synthetic polynucleotide
attctaatacgactcactatagggatgcagcggaagccagggtgttttagagctagaaatagcaagttaaaataaggctagtccgttatcaacttgaaaaagtggcaccgagtcggtgc

SEQ ID NO: 2293 - DNA, 23 bp, Artificial Sequence
  Description of Artificial Sequence: Synthetic oligonucleotide
catctgcctcgagagcttcacgg

SEQ ID NO: 2294 - DNA, 119 bp, Artificial Sequence
  Description of Artificial Sequence: Synthetic polynucleotide
attctaatacgactcactataggcatctgcctcgagagcttcagttttagagctagaaatagcaagttaaaataaggctagtccgttatcaacttgaaaaagtggcaccgagtcggtgc

SEQ ID NO: 2295 - DNA, 23 bp, Artificial Sequence
  Description of Artificial Sequence: Synthetic oligonucleotide
atctgcctcgagagcttcacggg

SEQ ID NO: 2296 - DNA, 119 bp, Artificial Sequence
  Description of Artificial Sequence: Synthetic polynucleotide
attctaatacgactcactataggatctgcctcgagagcttcacgttttagagctagaaatagcaagttaaaataaggctagtccgttatcaacttgaaaaagtggcaccgagtcggtgc

SEQ ID NO: 2297 - DNA, 23 bp, Artificial Sequence
  Description of Artificial Sequence: Synthetic oligonucleotide
ccactgcagccatggcagcaagg

SEQ ID NO: 2298 - DNA, 119 bp, Artificial Sequence
  Description of Artificial Sequence: Synthetic polynucleotide
attctaatacgactcactataggccactgcagccatggcagcagttttagagctagaaatagcaagttaaaataaggctagtccgttatcaacttgaaaaagtggcaccgagtcggtgc

SEQ ID NO: 2299 - DNA, 21 bp, Homo sapiens
ctgcagccatcgcagcaagga

SEQ ID NO: 2300 - DNA, 21 bp, Artificial Sequence
  Description of Artificial Sequence: Synthetic oligonucleotide
ctgcagccatggcagcaagga

SEQ ID NO: 2301 - DNA, 23 bp, Artificial Sequence
  Description of Artificial Sequence: Synthetic oligonucleotide
cagggctcccactgcagccatgg

SEQ ID NO: 2302 - DNA, 119 bp, Artificial Sequence
  Description of Artificial Sequence: Synthetic polynucleotide
attctaatacgactcactataggcagggctcccactgcagccagttttagagctagaaatagcaagttaaaataaggctagtccgttatcaacttgaaaaagtggcaccgagtcggtgc

SEQ ID NO: 2303 - DNA, 23 bp, Artificial Sequence
  Description of Artificial Sequence: Synthetic oligonucleotide
cagccatggcagcaaggaagcgg

SEQ ID NO: 2304 - DNA, 119 bp, Artificial Sequence
  Description of Artificial Sequence: Synthetic polynucleotide
attctaatacgactcactataggcagccatggcagcaaggaaggttttagagctagaaatagcaagttaaaataaggctagtccgttatcaacttgaaaaagtggcaccgagtcggtgc

SEQ ID NO: 2305 - DNA, 23 bp, Artificial Sequence
  Description of Artificial Sequence: Synthetic oligonucleotide
actccgcttccttgctgccatgg

SEQ ID NO: 2306 - DNA, 119 bp, Artificial Sequence
  Description of Artificial Sequence: Synthetic polynucleotide
attctaatacgactcactataggactccgcttccttgctgccagttttagagctagaaatagcaagttaaaataaggctagtccgttatcaacttgaaaaagtggcaccgagtcggtgc

SEQ ID NO: 2307 - DNA, 23 bp, Artificial Sequence
  Description of Artificial Sequence: Synthetic oligonucleotide
ccttgctgccatggctgcagtgg

SEQ ID NO: 2308 - DNA, 119 bp, Artificial Sequence
  Description of Artificial Sequence: Synthetic polynucleotide
attctaatacgactcactataggccttgctgccatggctgcaggttttagagctagaaatagcaagttaaaataaggctagtccgttatcaacttgaaaaagtggcaccgagtcggtgc

SEQ ID NO: 2309 - DNA, 23 bp, Artificial Sequence
  Description of Artificial Sequence: Synthetic oligonucleotide
catggctgcagtgggagccctgg

SEQ ID NO: 2310 - DNA, 119 bp, Artificial Sequence
  Description of Artificial Sequence: Synthetic polynucleotide
attctaatacgactcactataggcatggctgcagtgggagcccgttttagagctagaaatagcaagttaaaataaggctagtccgttatcaacttgaaaaagtggcaccgagtcggtgc

SEQ ID NO: 2311 - DNA, 23 bp, Artificial Sequence
  Description of Artificial Sequence: Synthetic oligonucleotide
cttgctgccatggctgcagtggg

SEQ ID NO: 2312 - DNA, 119 bp, Artificial Sequence
  Description of Artificial Sequence: Synthetic polynucleotide
attctaatacgactcactataggcttgctgccatggctgcagtgttttagagctagaaatagcaagttaaaataaggctagtccgttatcaacttgaaaaagtggcaccgagtcggtgc

SEQ ID NO: 2313 - DNA, 23 bp, Artificial Sequence
  Description of Artificial Sequence: Synthetic oligonucleotide
ggcatccgagagtgctcggcagg

SEQ ID NO: 2314 - DNA, 119 bp, Artificial Sequence
  Description of Artificial Sequence: Synthetic polynucleotide
attctaatacgactcactataggggcatccgagagtgctcggcgttttagagctagaaatagcaagttaaaataaggctagtccgttatcaacttgaaaaagtggcaccgagtcggtgc

SEQ ID NO: 2315 - DNA, 21 bp, Homo sapiens
tgaaggaggcgtccgagagtg

SEQ ID NO: 2316 - DNA, 21 bp, Artificial Sequence
  Description of Artificial Sequence: Synthetic oligonucleotide
tgaaggaggcatccgagagtg

SEQ ID NO: 2317 - DNA, 23 bp, Artificial Sequence
  Description of Artificial Sequence: Synthetic oligonucleotide
aggaggcatccgagagtgctcgg

SEQ ID NO: 2318 - DNA, 119 bp, Artificial Sequence
  Description of Artificial Sequence: Synthetic polynucleotide
attctaatacgactcactataggaggaggcatccgagagtgctgttttagagctagaaatagcaagttaaaataaggctagtccgttatcaacttgaaaaagtggcaccgagtcggtgc

SEQ ID NO: 2319 - DNA, 23 bp, Artificial Sequence
  Description of Artificial Sequence: Synthetic oligonucleotide
cggatgcctccttcagtgcctgg

SEQ ID NO: 2320 - DNA, 119 bp, Artificial Sequence
  Description of Artificial Sequence: Synthetic polynucleotide
attctaatacgactcactataggcggatgcctccttcagtgccgttttagagctagaaatagcaagttaaaataaggctagtccgttatcaacttgaaaaagtggcaccgagtcggtgc

SEQ ID NO: 2321 - DNA, 23 bp, Artificial Sequence
  Description of Artificial Sequence: Synthetic oligonucleotide
tgcctccttcagtgcctggatgg

SEQ ID NO: 2322 - DNA, 119 bp, Artificial Sequence
  Description of Artificial Sequence: Synthetic polynucleotide
attctaatacgactcactataggtgcctccttcagtgcctggagttttagagctagaaatagcaagttaaaataaggctagtccgttatcaacttgaaaaagtggcaccgagtcggtgc

SEQ ID NO: 2323 - DNA, 23 bp, Artificial Sequence
  Description of Artificial Sequence: Synthetic oligonucleotide
tgcattccattcactgtgcaagg

SEQ ID NO: 2324 - DNA, 119 bp, Artificial Sequence
  Description of Artificial Sequence: Synthetic polynucleotide
attctaatacgactcactataggtgcattccattcactgtgcagttttagagctagaaatagcaagttaaaataaggctagtccgttatcaacttgaaaaagtggcaccgagtcggtgc

SEQ ID NO: 2325 - DNA, 23 bp, Artificial Sequence
  Description of Artificial Sequence: Synthetic oligonucleotide
gggttgccttgcacagtgaatgg

SEQ ID NO: 2326 - DNA, 119 bp, Artificial Sequence
  Description of Artificial Sequence: Synthetic polynucleotide
attctaatacgactcactatagggggttgccttgcacagtgaagttttagagctagaaatagcaagttaaaataaggctagtccgttatcaacttgaaaaagtggcaccgagtcggtgc

SEQ ID NO: 2327 - DNA, 23 bp, Artificial Sequence
  Description of Artificial Sequence: Synthetic oligonucleotide
cagacgtgggggatctgtcaagg

SEQ ID NO: 2328 - DNA, 119 bp, Artificial Sequence
  Description of Artificial Sequence: Synthetic polynucleotide
attctaatacgactcactataggcagacgtgggggatctgtcagttttagagctagaaatagcaagttaaaataaggctagtccgttatcaacttgaaaaagtggcaccgagtcggtgc

SEQ ID NO: 2329 - DNA, 21 bp, Homo sapiens
aggctcaccacacgtggggga

SEQ ID NO: 2330 - DNA, 21 bp, Artificial Sequence
  Description of Artificial Sequence: Synthetic oligonucleotide
aggctcaccagacgtggggga

SEQ ID NO: 2331 - DNA, 23 bp, Artificial Sequence
  Description of Artificial Sequence: Synthetic oligonucleotide
tcctccaggctcaccagacgtgg

SEQ ID NO: 2332 - DNA, 119 bp, Artificial Sequence
  Description of Artificial Sequence: Synthetic polynucleotide
attctaatacgactcactataggtcctccaggctcaccagacggttttagagctagaaatagcaagttaaaataaggctagtccgttatcaacttgaaaaagtggcaccgagtcggtgc

SEQ ID NO: 2333 - DNA, 23 bp, Artificial Sequence
  Description of Artificial Sequence: Synthetic oligonucleotide
cctccaggctcaccagacgtggg

SEQ ID NO: 2334 - DNA, 119 bp, Artificial Sequence
  Description of Artificial Sequence: Synthetic polynucleotide
attctaatacgactcactataggcctccaggctcaccagacgtgttttagagctagaaatagcaagttaaaataaggctagtccgttatcaacttgaaaaagtggcaccgagtcggtgc

SEQ ID NO: 2335 - DNA, 23 bp, Artificial Sequence
  Description of Artificial Sequence: Synthetic oligonucleotide
ctccaggctcaccagacgtgggg

SEQ ID NO: 2336 - DNA, 119 bp, Artificial Sequence
  Description of Artificial Sequence: Synthetic polynucleotide
attctaatacgactcactataggctccaggctcaccagacgtggttttagagctagaaatagcaagttaaaataaggctagtccgttatcaacttgaaaaagtggcaccgagtcggtgc

SEQ ID NO: 2337 - DNA, 23 bp, Artificial Sequence
  Description of Artificial Sequence: Synthetic oligonucleotide
tccaggctcaccagacgtggggg

SEQ ID NO: 2338 - DNA, 119 bp, Artificial Sequence
  Description of Artificial Sequence: Synthetic polynucleotide
attctaatacgactcactataggtccaggctcaccagacgtgggttttagagctagaaatagcaagttaaaataaggctagtccgttatcaacttgaaaaagtggcaccgagtcggtgc

SEQ ID NO: 2339 - DNA, 23 bp, Artificial Sequence
  Description of Artificial Sequence: Synthetic oligonucleotide
agacgtgggggatctgtcaaggg

SEQ ID NO: 2340 - DNA, 119 bp, Artificial Sequence
  Description of Artificial Sequence: Synthetic polynucleotide
attctaatacgactcactataggagacgtgggggatctgtcaagttttagagctagaaatagcaagttaaaataaggctagtccgttatcaacttgaaaaagtggcaccgagtcggtgc

SEQ ID NO: 2341 - DNA, 23 bp, Artificial Sequence
  Description of Artificial Sequence: Synthetic oligonucleotide
cccacgtctggtgagcctggagg

SEQ ID NO: 2342 - DNA, 119 bp, Artificial Sequence
  Description of Artificial Sequence: Synthetic polynucleotide
attctaatacgactcactataggcccacgtctggtgagcctgggttttagagctagaaatagcaagttaaaataaggctagtccgttatcaacttgaaaaagtggcaccgagtcggtgc

SEQ ID NO: 2343 - DNA, 23 bp, Artificial Sequence
  Description of Artificial Sequence: Synthetic oligonucleotide
cttgacagatcccccacgtctgg

SEQ ID NO: 2344 - DNA, 119 bp, Artificial Sequence
  Description of Artificial Sequence: Synthetic polynucleotide
attctaatacgactcactataggcttgacagatcccccacgtcgttttagagctagaaatagcaagttaaaataaggctagtccgttatcaacttgaaaaagtggcaccgagtcggtgc

SEQ ID NO: 2345 - DNA, 23 bp, Artificial Sequence
  Description of Artificial Sequence: Synthetic oligonucleotide
tcccccacgtctggtgagcctgg

SEQ ID NO: 2346 - DNA, 119 bp, Artificial Sequence
  Description of Artificial Sequence: Synthetic polynucleotide
attctaatacgactcactataggtcccccacgtctggtgagccgttttagagctagaaatagcaagttaaaataaggctagtccgttatcaacttgaaaaagtggcaccgagtcggtgc

SEQ ID NO: 2347 - DNA, 23 bp, Artificial Sequence
  Description of Artificial Sequence: Synthetic oligonucleotide
gcccttccaggaggcggaagagg

SEQ ID NO: 2348 - DNA, 119 bp, Artificial Sequence
  Description of Artificial Sequence: Synthetic polynucleotide
attctaatacgactcactatagggcccttccaggaggcggaaggttttagagctagaaatagcaagttaaaataaggctagtccgttatcaacttgaaaaagtggcaccgagtcggtgc

SEQ ID NO: 2349 - DNA, 21 bp, Homo sapiens
ttccaggagggggaagaggtt

SEQ ID NO: 2350 - DNA, 21 bp, Artificial Sequence
  Description of Artificial Sequence: Synthetic oligonucleotide
ttccaggaggcggaagaggtt

SEQ ID NO: 2351 - DNA, 23 bp, Artificial Sequence
  Description of Artificial Sequence: Synthetic oligonucleotide
aatcctgcccttccaggaggcgg

SEQ ID NO: 2352 - DNA, 119 bp, Artificial Sequence
  Description of Artificial Sequence: Synthetic polynucleotide
attctaatacgactcactataggaatcctgcccttccaggagggttttagagctagaaatagcaagttaaaataaggctagtccgttatcaacttgaaaaagtggcaccgagtcggtgc

SEQ ID NO: 2353 - DNA, 23 bp, Artificial Sequence
  Description of Artificial Sequence: Synthetic oligonucleotide
cggaagaggttcccatcgtccgg

SEQ ID NO: 2354 - DNA, 119 bp, Artificial Sequence
  Description of Artificial Sequence: Synthetic polynucleotide
attctaatacgactcactataggcggaagaggttcccatcgtcgttttagagctagaaatagcaagttaaaataaggctagtccgttatcaacttgaaaaagtggcaccgagtcggtgc

SEQ ID NO: 2355 - DNA, 23 bp, Artificial Sequence
  Description of Artificial Sequence: Synthetic oligonucleotide
aacctcttccgcctcctggaagg

SEQ ID NO: 2356 - DNA, 119 bp, Artificial Sequence
  Description of Artificial Sequence: Synthetic polynucleotide
attctaatacgactcactataggaacctcttccgcctcctggagttttagagctagaaatagcaagttaaaataaggctagtccgttatcaacttgaaaaagtggcaccgagtcggtgc

SEQ ID NO: 2357 - DNA, 23 bp, Artificial Sequence
  Description of Artificial Sequence: Synthetic oligonucleotide
cttccgcctcctggaagggcagg

SEQ ID NO: 2358 - DNA, 119 bp, Artificial Sequence
  Description of Artificial Sequence: Synthetic polynucleotide
attctaatacgactcactataggcttccgcctcctggaagggcgttttagagctagaaatagcaagttaaaataaggctagtccgttatcaacttgaaaaagtggcaccgagtcggtgc

SEQ ID NO: 2359 - DNA, 23 bp, Artificial Sequence
  Description of Artificial Sequence: Synthetic oligonucleotide
tgggaacctcttccgcctcctgg

SEQ ID NO: 2360 - DNA, 119 bp, Artificial Sequence
  Description of Artificial Sequence: Synthetic polynucleotide
attctaatacgactcactataggtgggaacctcttccgcctccgttttagagctagaaatagcaagttaaaataaggctagtccgttatcaacttgaaaaagtggcaccgagtcggtgc

SEQ ID NO: 2361 - DNA, 23 bp, Artificial Sequence
  Description of Artificial Sequence: Synthetic oligonucleotide
acctcttccgcctcctggaaggg

SEQ ID NO: 2362 - DNA, 119 bp, Artificial Sequence
  Description of Artificial Sequence: Synthetic polynucleotide
attctaatacgactcactataggacctcttccgcctcctggaagttttagagctagaaatagcaagttaaaataaggctagtccgttatcaacttgaaaaagtggcaccgagtcggtgc

SEQ ID NO: 2363 - DNA, 23 bp, Artificial Sequence
  Description of Artificial Sequence: Synthetic oligonucleotide
ttgtgctgccagtgcagcgttgg

SEQ ID NO: 2364 - DNA, 119 bp, Artificial Sequence
  Description of Artificial Sequence: Synthetic polynucleotide
attctaatacgactcactataggttgtgctgccagtgcagcgtgttttagagctagaaatagcaagttaaaataaggctagtccgttatcaacttgaaaaagtggcaccgagtcggtgc

SEQ ID NO: 2365 - DNA, 21 bp, Homo sapiens
cccattgtgcagccagtgcag

SEQ ID NO: 2366 - DNA, 21 bp, Artificial Sequence
  Description of Artificial Sequence: Synthetic oligonucleotide
cccattgtgctgccagtgcag

SEQ ID NO: 2367 - DNA, 23 bp, Artificial Sequence
  Description of Artificial Sequence: Synthetic oligonucleotide
tgctgccagtgcagcgttggtgg

SEQ ID NO: 2368 - DNA, 119 bp, Artificial Sequence
  Description of Artificial Sequence: Synthetic polynucleotide
attctaatacgactcactataggtgctgccagtgcagcgttgggttttagagctagaaatagcaagttaaaataaggctagtccgttatcaacttgaaaaagtggcaccgagtcggtgc

SEQ ID NO: 2369 - DNA, 23 bp, Artificial Sequence
  Description of Artificial Sequence: Synthetic oligonucleotide
gctgccagtgcagcgttggtggg

SEQ ID NO: 2370 - DNA, 119 bp, Artificial Sequence
  Description of Artificial Sequence: Synthetic polynucleotide
attctaatacgactcactatagggctgccagtgcagcgttggtgttttagagctagaaatagcaagttaaaataaggctagtccgttatcaacttgaaaaagtggcaccgagtcggtgc

SEQ ID NO: 2371 - DNA, 23 bp, Artificial Sequence
  Description of Artificial Sequence: Synthetic oligonucleotide
ctgccagtgcagcgttggtgggg

SEQ ID NO: 2372 - DNA, 119 bp, Artificial Sequence
  Description of Artificial Sequence: Synthetic polynucleotide
attctaatacgactcactataggctgccagtgcagcgttggtggttttagagctagaaatagcaagttaaaataaggctagtccgttatcaacttgaaaaagtggcaccgagtcggtgc

SEQ ID NO: 2373 - DNA, 23 bp, Artificial Sequence
  Description of Artificial Sequence: Synthetic oligonucleotide
tgccagtgcagcgttggtggggg

SEQ ID NO: 2374 - DNA, 119 bp, Artificial Sequence
  Description of Artificial Sequence: Synthetic polynucleotide
attctaatacgactcactataggtgccagtgcagcgttggtgggttttagagctagaaatagcaagttaaaataaggctagtccgttatcaacttgaaaaagtggcaccgagtcggtgc

SEQ ID NO: 2375 - DNA, 23 bp, Artificial Sequence
  Description of Artificial Sequence: Synthetic oligonucleotide
acgctgcactggcagcacaatgg

SEQ ID NO: 2376 - DNA, 119 bp, Artificial Sequence
  Description of Artificial Sequence: Synthetic polynucleotide
attctaatacgactcactataggacgctgcactggcagcacaagttttagagctagaaatagcaagttaaaataaggctagtccgttatcaacttgaaaaagtggcaccgagtcggtgc

SEQ ID NO: 2377 - DNA, 23 bp, Artificial Sequence
  Description of Artificial Sequence: Synthetic oligonucleotide
agcacaatgggcagcctctgcgg

SEQ ID NO: 2378 - DNA, 119 bp, Artificial Sequence
  Description of Artificial Sequence: Synthetic polynucleotide
attctaatacgactcactataggagcacaatgggcagcctctggttttagagctagaaatagcaagttaaaataaggctagtccgttatcaacttgaaaaagtggcaccgagtcggtgc

SEQ ID NO: 2379 - DNA, 23 bp, Artificial Sequence
  Description of Artificial Sequence: Synthetic oligonucleotide
cgctgcactggcagcacaatggg

SEQ ID NO: 2380 - DNA, 119 bp, Artificial Sequence
  Description of Artificial Sequence: Synthetic polynucleotide
attctaatacgactcactataggcgctgcactggcagcacaatgttttagagctagaaatagcaagttaaaataaggctagtccgttatcaacttgaaaaagtggcaccgagtcggtgc

SEQ ID NO: 2381 - DNA, 23 bp, Artificial Sequence
  Description of Artificial Sequence: Synthetic oligonucleotide
actattctccctgtacttttcgg

SEQ ID NO: 2382 - DNA, 119 bp, Artificial Sequence
  Description of Artificial Sequence: Synthetic polynucleotide
attctaatacgactcactataggactattctccctgtacttttgttttagagctagaaatagcaagttaaaataaggctagtccgttatcaacttgaaaaagtggcaccgagtcggtgc

SEQ ID NO: 2383 - DNA, 21 bp, Homo sapiens
catagagactcttctccctgt

SEQ ID NO: 2384 - DNA, 21 bp, Artificial Sequence
  Description of Artificial Sequence: Synthetic oligonucleotide
catagagactattctccctgt

SEQ ID NO: 2385 - DNA, 23 bp, Artificial Sequence
  Description of Artificial Sequence: Synthetic oligonucleotide
tacagggagaatagtctctatgg

SEQ ID NO: 2386 - DNA, 119 bp, Artificial Sequence
  Description of Artificial Sequence: Synthetic polynucleotide
attctaatacgactcactataggtacagggagaatagtctctagttttagagctagaaatagcaagttaaaataaggctagtccgttatcaacttgaaaaagtggcaccgagtcggtgc

SEQ ID NO: 2387 - DNA, 23 bp, Artificial Sequence
  Description of Artificial Sequence: Synthetic oligonucleotide
tagtctctatggagatgatctgg

SEQ ID NO: 2388 - DNA, 119 bp, Artificial Sequence
  Description of Artificial Sequence: Synthetic polynucleotide
attctaatacgactcactataggtagtctctatggagatgatcgttttagagctagaaatagcaagttaaaataaggctagtccgttatcaacttgaaaaagtggcaccgagtcggtgc

SEQ ID NO: 2389 - DNA, 23 bp, Artificial Sequence
  Description of Artificial Sequence: Synthetic oligonucleotide
ctaagtcaagtattcgaatgagg

SEQ ID NO: 2390 - DNA, 119 bp, Artificial Sequence
  Description of Artificial Sequence: Synthetic polynucleotide
attctaatacgactcactataggctaagtcaagtattcgaatggttttagagctagaaatagcaagttaaaataaggctagtccgttatcaacttgaaaaagtggcaccgagtcggtgc

SEQ ID NO: 2391 - DNA, 23 bp, Artificial Sequence
  Description of Artificial Sequence: Synthetic oligonucleotide
gtcaagtattcgaatgaggtagg

SEQ ID NO: 2392 - DNA, 119 bp, Artificial Sequence
  Description of Artificial Sequence: Synthetic polynucleotide
attctaatacgactcactatagggtcaagtattcgaatgaggtgttttagagctagaaatagcaagttaaaataaggctagtccgttatcaacttgaaaaagtggcaccgagtcggtgc

SEQ ID NO: 2393 - DNA, 23 bp, Artificial Sequence
  Description of Artificial Sequence: Synthetic oligonucleotide
gaagaatacaaacaactcagagg

SEQ ID NO: 2394 - DNA, 119 bp, Artificial Sequence
  Description of Artificial Sequence: Synthetic polynucleotide
attctaatacgactcactatagggaagaatacaaacaactcaggttttagagctagaaatagcaagttaaaataaggctagtccgttatcaacttgaaaaagtggcaccgagtcggtgc

SEQ ID NO: 2395 - DNA, 23 bp, Artificial Sequence
  Description of Artificial Sequence: Synthetic oligonucleotide
tgcctcgctaagaatctccttgg

SEQ ID NO: 2396 - DNA, 119 bp, Artificial Sequence
  Description of Artificial Sequence: Synthetic polynucleotide
attctaatacgactcactataggtgcctcgctaagaatctcctgttttagagctagaaatagcaagttaaaataaggctagtccgttatcaacttgaaaaagtggcaccgagtcggtgc

SEQ ID NO: 2397 - DNA, 21 bp, Homo sapiens
tgcgatgcctggctaagaatc

SEQ ID NO: 2398 - DNA, 21 bp, Artificial Sequence
  Description of Artificial Sequence: Synthetic oligonucleotide
tgcgatgcctcgctaagaatc

SEQ ID NO: 2399 - DNA, 23 bp, Artificial Sequence
  Description of Artificial Sequence: Synthetic oligonucleotide
ctccaaggagattcttagcgagg

SEQ ID NO: 2400 - DNA, 119 bp, Artificial Sequence
  Description of Artificial Sequence: Synthetic polynucleotide
attctaatacgactcactataggctccaaggagattcttagcggttttagagctagaaatagcaagttaaaataaggctagtccgttatcaacttgaaaaagtggcaccgagtcggtgc

SEQ ID NO: 2401 - DNA, 23 bp, Artificial Sequence
  Description of Artificial Sequence: Synthetic oligonucleotide
agcgaggcatcgcacggcgatgg

SEQ ID NO: 2402 - DNA, 119 bp, Artificial Sequence
  Description of Artificial Sequence: Synthetic polynucleotide
attctaatacgactcactataggagcgaggcatcgcacggcgagttttagagctagaaatagcaagttaaaataaggctagtccgttatcaacttgaaaaagtggcaccgagtcggtgc

SEQ ID NO: 2403 - DNA, 23 bp, Artificial Sequence
  Description of Artificial Sequence: Synthetic oligonucleotide
attcttagcgaggcatcgcacgg

SEQ ID NO: 2404 - DNA, 119 bp, Artificial Sequence
  Description of Artificial Sequence: Synthetic polynucleotide
attctaatacgactcactataggattcttagcgaggcatcgcagttttagagctagaaatagcaagttaaaataaggctagtccgttatcaacttgaaaaagtggcaccgagtcggtgc

SEQ ID NO: 2405 - DNA, 23 bp, Artificial Sequence
  Description of Artificial Sequence: Synthetic oligonucleotide
ttcagatgtctgcgagctggagg

SEQ ID NO: 2406 - DNA, 119 bp, Artificial Sequence
  Description of Artificial Sequence: Synthetic polynucleotide
attctaatacgactcactataggttcagatgtctgcgagctgggttttagagctagaaatagcaagttaaaataaggctagtccgttatcaacttgaaaaagtggcaccgagtcggtgc

SEQ ID NO: 2407 - DNA, 21 bp, Homo sapiens
gctcgcagacctctgaagaga

SEQ ID NO: 2408 - DNA, 21 bp, Artificial Sequence
  Description of Artificial Sequence: Synthetic oligonucleotide
gctcgcagacatctgaagaga

SEQ ID NO: 2409 - DNA, 23 bp, Artificial Sequence
  Description of Artificial Sequence: Synthetic oligonucleotide
agatgtctgcgagctggaggagg

SEQ ID NO: 2410 - DNA, 119 bp, Artificial Sequence
  Description of Artificial Sequence: Synthetic polynucleotide
attctaatacgactcactataggagatgtctgcgagctggagggttttagagctagaaatagcaagttaaaataaggctagtccgttatcaacttgaaaaagtggcaccgagtcggtgc

SEQ ID NO: 2411 - DNA, 23 bp, Artificial Sequence
  Description of Artificial Sequence: Synthetic oligonucleotide
ctcttcagatgtctgcgagctgg

SEQ ID NO: 2412 - DNA, 119 bp, Artificial Sequence
  Description of Artificial Sequence: Synthetic polynucleotide
attctaatacgactcactataggctcttcagatgtctgcgagcgttttagagctagaaatagcaagttaaaataaggctagtccgttatcaacttgaaaaagtggcaccgagtcggtgc

SEQ ID NO: 2413 - DNA, 23 bp, Artificial Sequence
  Description of Artificial Sequence: Synthetic oligonucleotide
gatgtctgcgagctggaggaggg

SEQ ID NO: 2414 - DNA, 119 bp, Artificial Sequence
  Description of Artificial Sequence: Synthetic polynucleotide
attctaatacgactcactatagggatgtctgcgagctggaggagttttagagctagaaatagcaagttaaaataaggctagtccgttatcaacttgaaaaagtggcaccgagtcggtgc

SEQ ID NO: 2415 - DNA, 23 bp, Artificial Sequence
  Description of Artificial Sequence: Synthetic oligonucleotide
gttgatcagagttgctcggcagg

SEQ ID NO: 2416 - DNA, 119 bp, Artificial Sequence
  Description of Artificial Sequence: Synthetic polynucleotide
attctaatacgactcactatagggttgatcagagttgctcggcgttttagagctagaaatagcaagttaaaataaggctagtccgttatcaacttgaaaaagtggcaccgagtcggtgc

SEQ ID NO: 2417 - DNA, 21 bp, Homo sapiens
tcgttgatcaaagttgctcgg

SEQ ID NO: 2418 - DNA, 21 bp, Artificial Sequence
  Description of Artificial Sequence: Synthetic oligonucleotide
tcgttgatcagagttgctcgg

SEQ ID NO: 2419 - DNA, 23 bp, Artificial Sequence
  Description of Artificial Sequence: Synthetic oligonucleotide
actcgttgatcagagttgctcgg

SEQ ID NO: 2420 - DNA, 119 bp, Artificial Sequence
  Description of Artificial Sequence: Synthetic polynucleotide
attctaatacgactcactataggactcgttgatcagagttgctgttttagagctagaaatagcaagttaaaataaggctagtccgttatcaacttgaaaaagtggcaccgagtcggtgc

SEQ ID NO: 2421 - DNA, 23 bp, Artificial Sequence
  Description of Artificial Sequence: Synthetic oligonucleotide
ccttctgccaaagcataatgagg

SEQ ID NO: 2422 - DNA, 119 bp, Artificial Sequence
  Description of Artificial Sequence: Synthetic polynucleotide
attctaatacgactcactataggccttctgccaaagcataatggttttagagctagaaatagcaagttaaaataaggctagtccgttatcaacttgaaaaagtggcaccgagtcggtgc

SEQ ID NO: 2423 - DNA, 21 bp, Homo sapiens
gccaaagcatgatgaggatga

SEQ ID NO: 2424 - DNA, 21 bp, Artificial Sequence
  Description of Artificial Sequence: Synthetic oligonucleotide
gccaaagcataatgaggatga

SEQ ID NO: 2425 - DNA, 23 bp, Artificial Sequence
  Description of Artificial Sequence: Synthetic oligonucleotide
aaagcataatgaggatgataagg

SEQ ID NO: 2426 - DNA, 119 bp, Artificial Sequence
  Description of Artificial Sequence: Synthetic polynucleotide
attctaatacgactcactataggaaagcataatgaggatgatagttttagagctagaaatagcaagttaaaataaggctagtccgttatcaacttgaaaaagtggcaccgagtcggtgc

SEQ ID NO: 2427 - DNA, 23 bp, Artificial Sequence
  Description of Artificial Sequence: Synthetic oligonucleotide
aagcataatgaggatgataaggg

SEQ ID NO: 2428 - DNA, 119 bp, Artificial Sequence
  Description of Artificial Sequence: Synthetic polynucleotide
attctaatacgactcactataggaagcataatgaggatgataagttttagagctagaaatagcaagttaaaataaggctagtccgttatcaacttgaaaaagtggcaccgagtcggtgc

SEQ ID NO: 2429 - DNA, 23 bp, Artificial Sequence
  Description of Artificial Sequence: Synthetic oligonucleotide
cctcattatgctttggcagaagg

SEQ ID NO: 2430 - DNA, 119 bp, Artificial Sequence
  Description of Artificial Sequence: Synthetic polynucleotide
attctaatacgactcactataggcctcattatgctttggcagagttttagagctagaaatagcaagttaaaataaggctagtccgttatcaacttgaaaaagtggcaccgagtcggtgc

SEQ ID NO: 2431 - DNA, 23 bp, Artificial Sequence
  Description of Artificial Sequence: Synthetic oligonucleotide
ttatcatcctcattatgctttgg

SEQ ID NO: 2432 - DNA, 119 bp, Artificial Sequence
  Description of Artificial Sequence: Synthetic polynucleotide
attctaatacgactcactataggttatcatcctcattatgcttgttttagagctagaaatagcaagttaaaataaggctagtccgttatcaacttgaaaaagtggcaccgagtcggtgc

SEQ ID NO: 2433 - DNA, 23 bp, Artificial Sequence
  Description of Artificial Sequence: Synthetic oligonucleotide
gcaggaatataacaccacgctgg

SEQ ID NO: 2434 - DNA, 119 bp, Artificial Sequence
  Description of Artificial Sequence: Synthetic polynucleotide
attctaatacgactcactatagggcaggaatataacaccacgcgttttagagctagaaatagcaagttaaaataaggctagtccgttatcaacttgaaaaagtggcaccgagtcggtgc

SEQ ID NO: 2435 - DNA, 21 bp, Homo sapiens
gtggtgttatgttcctgccca

SEQ ID NO: 2436 - DNA, 21 bp, Artificial Sequence
  Description of Artificial Sequence: Synthetic oligonucleotide
gtggtgttatattcctgccca

SEQ ID NO: 2437 - DNA, 23 bp, Artificial Sequence
  Description of Artificial Sequence: Synthetic oligonucleotide
aatataacaccacgctggactgg

SEQ ID NO: 2438 - DNA, 119 bp, Artificial Sequence
  Description of Artificial Sequence: Synthetic polynucleotide
attctaatacgactcactataggaatataacaccacgctggacgttttagagctagaaatagcaagttaaaataaggctagtccgttatcaacttgaaaaagtggcaccgagtcggtgc

SEQ ID NO: 2439 - DNA, 23 bp, Artificial Sequence
  Description of Artificial Sequence: Synthetic oligonucleotide
cggagaagtctgcctgtaagagg

SEQ ID NO: 2440 - DNA, 119 bp, Artificial Sequence
  Description of Artificial Sequence: Synthetic polynucleotide
attctaatacgactcactataggcggagaagtctgcctgtaaggttttagagctagaaatagcaagttaaaataaggctagtccgttatcaacttgaaaaagtggcaccgagtcggtgc

SEQ ID NO: 2441 - DNA, 21 bp, Homo sapiens
cggagaagtccgcctgtaaga

SEQ ID NO: 2442 - DNA, 21 bp, Artificial Sequence
  Description of Artificial Sequence: Synthetic oligonucleotide
cggagaagtctgcctgtaaga

SEQ ID NO: 2443 - DNA, 23 bp, Artificial Sequence
  Description of Artificial Sequence: Synthetic oligonucleotide
atggttcaatgctcattaacagg

SEQ ID NO: 2444 - DNA, 119 bp, Artificial Sequence
  Description of Artificial Sequence: Synthetic polynucleotide
attctaatacgactcactataggatggttcaatgctcattaacgttttagagctagaaatagcaagttaaaataaggctagtccgttatcaacttgaaaaagtggcaccgagtcggtgc

SEQ ID NO: 2445 - DNA, 21 bp, Homo sapiens
tagatcacatctggttcaatg

SEQ ID NO: 2446 - DNA, 21 bp, Artificial Sequence
  Description of Artificial Sequence: Synthetic oligonucleotide
tagatcacatatggttcaatg

SEQ ID NO: 2447 - DNA, 23 bp, Artificial Sequence
  Description of Artificial Sequence: Synthetic oligonucleotide
tgtcctgcatagatcacatatgg

SEQ ID NO: 2448 - DNA, 119 bp, Artificial Sequence
  Description of Artificial Sequence: Synthetic polynucleotide
attctaatacgactcactataggtgtcctgcatagatcacatagttttagagctagaaatagcaagttaaaataaggctagtccgttatcaacttgaaaaagtggcaccgagtcggtgc

SEQ ID NO: 2449 - DNA, 23 bp, Artificial Sequence
  Description of Artificial Sequence: Synthetic oligonucleotide
gaaccatatgtgatctatgcagg

SEQ ID NO: 2450 - DNA, 119 bp, Artificial Sequence
  Description of Artificial Sequence: Synthetic polynucleotide
attctaatacgactcactatagggaaccatatgtgatctatgcgttttagagctagaaatagcaagttaaaataaggctagtccgttatcaacttgaaaaagtggcaccgagtcggtgc

SEQ ID NO: 2451 - DNA, 23 bp, Artificial Sequence
  Description of Artificial Sequence: Synthetic oligonucleotide
gctcttcactaagccggctttgg

SEQ ID NO: 2452 - DNA, 119 bp, Artificial Sequence
  Description of Artificial Sequence: Synthetic polynucleotide
attctaatacgactcactatagggctcttcactaagccggcttgttttagagctagaaatagcaagttaaaataaggctagtccgttatcaacttgaaaaagtggcaccgagtcggtgc

SEQ ID NO: 2453 - DNA, 21 bp, Homo sapiens
cttcactaaggcggctttggc

SEQ ID NO: 2454 - DNA, 21 bp, Artificial Sequence
  Description of Artificial Sequence: Synthetic oligonucleotide
cttcactaagccggctttggc

SEQ ID NO: 2455 - DNA, 23 bp, Artificial Sequence
  Description of Artificial Sequence: Synthetic oligonucleotide
taagccggctttggcaccgttgg

SEQ ID NO: 2456 - DNA, 119 bp, Artificial Sequence
  Description of Artificial Sequence: Synthetic polynucleotide
attctaatacgactcactataggtaagccggctttggcaccgtgttttagagctagaaatagcaagttaaaataaggctagtccgttatcaacttgaaaaagtggcaccgagtcggtgc

SEQ ID NO: 2457 - DNA, 23 bp, Artificial Sequence
  Description of Artificial Sequence: Synthetic oligonucleotide
catactgctcttcactaagccgg

SEQ ID NO: 2458 - DNA, 119 bp, Artificial Sequence
  Description of Artificial Sequence: Synthetic polynucleotide
attctaatacgactcactataggcatactgctcttcactaagcgttttagagctagaaatagcaagttaaaataaggctagtccgttatcaacttgaaaaagtggcaccgagtcggtgc

SEQ ID NO: 2459 - DNA, 23 bp, Artificial Sequence
  Description of Artificial Sequence: Synthetic oligonucleotide
aagccggctttggcaccgttggg

SEQ ID NO: 2460 - DNA, 119 bp, Artificial Sequence
  Description of Artificial Sequence: Synthetic polynucleotide
attctaatacgactcactataggaagccggctttggcaccgttgttttagagctagaaatagcaagttaaaataaggctagtccgttatcaacttgaaaaagtggcaccgagtcggtgc

SEQ ID NO: 2461 - DNA, 23 bp, Artificial Sequence
  Description of Artificial Sequence: Synthetic oligonucleotide
ggtcatgcacaaacgtttggagg

SEQ ID NO: 2462 - DNA, 119 bp, Artificial Sequence
  Description of Artificial Sequence: Synthetic polynucleotide
attctaatacgactcactataggggtcatgcacaaacgtttgggttttagagctagaaatagcaagttaaaataaggctagtccgttatcaacttgaaaaagtggcaccgagtcggtgc

SEQ ID NO: 2463 - DNA, 23 bp, Artificial Sequence
  Description of Artificial Sequence: Synthetic oligonucleotide
aaacgtttggagggataaaaagg

SEQ ID NO: 2464 - DNA, 119 bp, Artificial Sequence
  Description of Artificial Sequence: Synthetic polynucleotide
attctaatacgactcactataggaaacgtttggagggataaaagttttagagctagaaatagcaagttaaaataaggctagtccgttatcaacttgaaaaagtggcaccgagtcggtgc

SEQ ID NO: 2465 - DNA, 23 bp, Artificial Sequence
  Description of Artificial Sequence: Synthetic oligonucleotide
ttaggtcatgcacaaacgtttgg

SEQ ID NO: 2466 - DNA, 119 bp, Artificial Sequence
  Description of Artificial Sequence: Synthetic polynucleotide
attctaatacgactcactataggttaggtcatgcacaaacgttgttttagagctagaaatagcaagttaaaataaggctagtccgttatcaacttgaaaaagtggcaccgagtcggtgc

SEQ ID NO: 2467 - DNA, 23 bp, Artificial Sequence
  Description of Artificial Sequence: Synthetic oligonucleotide
gtcatgcacaaacgtttggaggg

SEQ ID NO: 2468 - DNA, 119 bp, Artificial Sequence
  Description of Artificial Sequence: Synthetic polynucleotide
attctaatacgactcactatagggtcatgcacaaacgtttggagttttagagctagaaatagcaagttaaaataaggctagtccgttatcaacttgaaaaagtggcaccgagtcggtgc

SEQ ID NO: 2469 - DNA, 23 bp, Artificial Sequence
  Description of Artificial Sequence: Synthetic oligonucleotide
taaattctgcagaaatagttagg

SEQ ID NO: 2470 - DNA, 119 bp, Artificial Sequence
  Description of Artificial Sequence: Synthetic polynucleotide
attctaatacgactcactataggtaaattctgcagaaatagttgttttagagctagaaatagcaagttaaaataaggctagtccgttatcaacttgaaaaagtggcaccgagtcggtgc

SEQ ID NO: 2471 - DNA, 21 bp, Homo sapiens
gcagaaatagataggtatgga

SEQ ID NO: 2472 - DNA, 21 bp, Artificial Sequence
  Description of Artificial Sequence: Synthetic oligonucleotide
gcagaaatagttaggtatgga

SEQ ID NO: 2473 - DNA, 23 bp, Artificial Sequence
  Description of Artificial Sequence: Synthetic oligonucleotide
atagttaggtatggatatccagg

SEQ ID NO: 2474 - DNA, 119 bp, Artificial Sequence
  Description of Artificial Sequence: Synthetic polynucleotide
attctaatacgactcactataggatagttaggtatggatatccgttttagagctagaaatagcaagttaaaataaggctagtccgttatcaacttgaaaaagtggcaccgagtcggtgc

SEQ ID NO: 2475 - DNA, 23 bp, Artificial Sequence
  Description of Artificial Sequence: Synthetic oligonucleotide
ttaggtatggatatccagggagg

SEQ ID NO: 2476 - DNA, 119 bp, Artificial Sequence
  Description of Artificial Sequence: Synthetic polynucleotide
attctaatacgactcactataggttaggtatggatatccaggggttttagagctagaaatagcaagttaaaataaggctagtccgttatcaacttgaaaaagtggcaccgagtcggtgc

SEQ ID NO: 2477 - DNA, 23 bp, Artificial Sequence
  Description of Artificial Sequence: Synthetic oligonucleotide
tctgcagaaatagttaggtatgg

SEQ ID NO: 2478 - DNA, 119 bp, Artificial Sequence
  Description of Artificial Sequence: Synthetic polynucleotide
attctaatacgactcactataggtctgcagaaatagttaggtagttttagagctagaaatagcaagttaaaataaggctagtccgttatcaacttgaaaaagtggcaccgagtcggtgc

SEQ ID NO: 2479 - DNA, 23 bp, Artificial Sequence
  Description of Artificial Sequence: Synthetic oligonucleotide
tagttaggtatggatatccaggg

SEQ ID NO: 2480 - DNA, 119 bp, Artificial Sequence
  Description of Artificial Sequence: Synthetic polynucleotide
attctaatacgactcactataggtagttaggtatggatatccagttttagagctagaaatagcaagttaaaataaggctagtccgttatcaacttgaaaaagtggcaccgagtcggtgc

SEQ ID NO: 2481 - DNA, 23 bp, Artificial Sequence
  Description of Artificial Sequence: Synthetic oligonucleotide
gaatgtaacccttaaatgtgagg

SEQ ID NO: 2482 - DNA, 119 bp, Artificial Sequence
  Description of Artificial Sequence: Synthetic polynucleotide
attctaatacgactcactatagggaatgtaacccttaaatgtggttttagagctagaaatagcaagttaaaataaggctagtccgttatcaacttgaaaaagtggcaccgagtcggtgc

SEQ ID NO: 2483 - DNA, 23 bp, Artificial Sequence
  Description of Artificial Sequence: Synthetic oligonucleotide
aatgtaacccttaaatgtgaggg

SEQ ID NO: 2484 - DNA, 119 bp, Artificial Sequence
  Description of Artificial Sequence: Synthetic polynucleotide
attctaatacgactcactataggaatgtaacccttaaatgtgagttttagagctagaaatagcaagttaaaataaggctagtccgttatcaacttgaaaaagtggcaccgagtcggtgc

SEQ ID NO: 2485 - DNA, 23 bp, Artificial Sequence
  Description of Artificial Sequence: Synthetic oligonucleotide
gggttacattcaacaatgcttgg

SEQ ID NO: 2486 - DNA, 119 bp, Artificial Sequence
  Description of Artificial Sequence: Synthetic polynucleotide
attctaatacgactcactatagggggttacattcaacaatgctgttttagagctagaaatagcaagttaaaataaggctagtccgttatcaacttgaaaaagtggcaccgagtcggtgc

SEQ ID NO: 2487 - DNA, 23 bp, Artificial Sequence
  Description of Artificial Sequence: Synthetic oligonucleotide
tttattaaagattttgctatcgg

SEQ ID NO: 2488 - DNA, 119 bp, Artificial Sequence
  Description of Artificial Sequence: Synthetic polynucleotide
attctaatacgactcactataggtttattaaagattttgctatgttttagagctagaaatagcaagttaaaataaggctagtccgttatcaacttgaaaaagtggcaccgagtcggtgc

SEQ ID NO: 2489 - DNA, 23 bp, Artificial Sequence
  Description of Artificial Sequence: Synthetic oligonucleotide
tctctctgaaatcactaagcagg

SEQ ID NO: 2490 - DNA, 119 bp, Artificial Sequence
  Description of Artificial Sequence: Synthetic polynucleotide
attctaatacgactcactataggtctctctgaaatcactaagcgttttagagctagaaatagcaagttaaaataaggctagtccgttatcaacttgaaaaagtggcaccgagtcggtgc

SEQ ID NO: 2491 - DNA, 23 bp, Artificial Sequence
  Description of Artificial Sequence: Synthetic oligonucleotide
tgcttagtgatttcagagagagg

SEQ ID NO: 2492 - DNA, 119 bp, Artificial Sequence
  Description of Artificial Sequence: Synthetic polynucleotide
attctaatacgactcactataggtgcttagtgatttcagagaggttttagagctagaaatagcaagttaaaataaggctagtccgttatcaacttgaaaaagtggcaccgagtcggtgc

SEQ ID NO: 2493 - DNA, 23 bp, Artificial Sequence
  Description of Artificial Sequence: Synthetic oligonucleotide
tctctctaaaatcactgagcagg

SEQ ID NO: 2494 - DNA, 119 bp, Artificial Sequence
  Description of Artificial Sequence: Synthetic polynucleotide
attctaatacgactcactataggtctctctaaaatcactgagcgttttagagctagaaatagcaagttaaaataaggctagtccgttatcaacttgaaaaagtggcaccgagtcggtgc

SEQ ID NO: 2495 - DNA, 23 bp, Artificial Sequence
  Description of Artificial Sequence: Synthetic oligonucleotide
tgctcagtgattttagagagagg

SEQ ID NO: 2496 - DNA, 119 bp, Artificial Sequence
  Description of Artificial Sequence: Synthetic polynucleotide
attctaatacgactcactataggtgctcagtgattttagagaggttttagagctagaaatagcaagttaaaataaggctagtccgttatcaacttgaaaaagtggcaccgagtcggtgc

SEQ ID NO: 2497 - DNA, 23 bp, Artificial Sequence
  Description of Artificial Sequence: Synthetic oligonucleotide
tgaacttacgtagaatatattgg

SEQ ID NO: 2498 - DNA, 119 bp, Artificial Sequence
  Description of Artificial Sequence: Synthetic polynucleotide
attctaatacgactcactataggtgaacttacgtagaatatatgttttagagctagaaatagcaagttaaaataaggctagtccgttatcaacttgaaaaagtggcaccgagtcggtgc

SEQ ID NO: 2499 - DNA, 23 bp, Artificial Sequence
  Description of Artificial Sequence: Synthetic oligonucleotide
atatattctacgtaagttcacgg

SEQ ID NO: 2500 - DNA, 119 bp, Artificial Sequence
  Description of Artificial Sequence: Synthetic polynucleotide
attctaatacgactcactataggatatattctacgtaagttcagttttagagctagaaatagcaagttaaaataaggctagtccgttatcaacttgaaaaagtggcaccgagtcggtgc

SEQ ID NO: 2501 - DNA, 23 bp, Artificial Sequence
  Description of Artificial Sequence: Synthetic oligonucleotide
aatgatcgatgttcacgttttgg

SEQ ID NO: 2502 - DNA, 119 bp, Artificial Sequence
  Description of Artificial Sequence: Synthetic polynucleotide
attctaatacgactcactataggaatgatcgatgttcacgtttgttttagagctagaaatagcaagttaaaataaggctagtccgttatcaacttgaaaaagtggcaccgagtcggtgc

SEQ ID NO: 2503 - DNA, 23 bp, Artificial Sequence
  Description of Artificial Sequence: Synthetic oligonucleotide
ttttctcatcataatgggccagg

SEQ ID NO: 2504 - DNA, 119 bp, Artificial Sequence
  Description of Artificial Sequence: Synthetic polynucleotide
attctaatacgactcactataggttttctcatcataatgggccgttttagagctagaaatagcaagttaaaataaggctagtccgttatcaacttgaaaaagtggcaccgagtcggtgc

SEQ ID NO: 2505 - DNA, 23 bp, Artificial Sequence
  Description of Artificial Sequence: Synthetic oligonucleotide
ttttgcaaagctaccctgaaagg

SEQ ID NO: 2506 - DNA, 119 bp, Artificial Sequence
  Description of Artificial Sequence: Synthetic polynucleotide
attctaatacgactcactataggttttgcaaagctaccctgaagttttagagctagaaatagcaagttaaaataaggctagtccgttatcaacttgaaaaagtggcaccgagtcggtgc

SEQ ID NO: 2507 - DNA, 23 bp, Artificial Sequence
  Description of Artificial Sequence: Synthetic oligonucleotide
ggcgatgtccctggggcgggagg

SEQ ID NO: 2508 - DNA, 119 bp, Artificial Sequence
  Description of Artificial Sequence: Synthetic polynucleotide
attctaatacgactcactataggggcgatgtccctggggcggggttttagagctagaaatagcaagttaaaataaggctagtccgttatcaacttgaaaaagtggcaccgagtcggtgc

SEQ ID NO: 2509 - DNA, 21 bp, Homo sapiens
tgaggcgatggccctggggcg

SEQ ID NO: 2510 - DNA, 21 bp, Artificial Sequence
  Description of Artificial Sequence: Synthetic oligonucleotide
tgaggcgatgtccctggggcg

SEQ ID NO: 2511 - DNA, 23 bp, Artificial Sequence
  Description of Artificial Sequence: Synthetic oligonucleotide
ggtggctgaggcgatgtccctgg

SEQ ID NO: 2512 - DNA, 119 bp, Artificial Sequence
  Description of Artificial Sequence: Synthetic polynucleotide
attctaatacgactcactataggggtggctgaggcgatgtcccgttttagagctagaaatagcaagttaaaataaggctagtccgttatcaacttgaaaaagtggcaccgagtcggtgc

SEQ ID NO: 2513 - DNA, 23 bp, Artificial Sequence
  Description of Artificial Sequence: Synthetic oligonucleotide
ctgaggcgatgtccctggggcgg

SEQ ID NO: 2514 - DNA, 119 bp, Artificial Sequence
  Description of Artificial Sequence: Synthetic polynucleotide
attctaatacgactcactataggctgaggcgatgtccctgggggttttagagctagaaatagcaagttaaaataaggctagtccgttatcaacttgaaaaagtggcaccgagtcggtgc

SEQ ID NO: 2515 - DNA, 23 bp, Artificial Sequence
  Description of Artificial Sequence: Synthetic oligonucleotide
gtccctggggcgggaggccgcgg

SEQ ID NO: 2516 - DNA, 119 bp, Artificial Sequence
  Description of Artificial Sequence: Synthetic polynucleotide
attctaatacgactcactatagggtccctggggcgggaggccggttttagagctagaaatagcaagttaaaataaggctagtccgttatcaacttgaaaaagtggcaccgagtcggtgc

SEQ ID NO: 2517 - DNA, 23 bp, Artificial Sequence
  Description of Artificial Sequence: Synthetic oligonucleotide
gtggctgaggcgatgtccctggg

SEQ ID NO: 2518 - DNA, 119 bp, Artificial Sequence
  Description of Artificial Sequence: Synthetic polynucleotide
attctaatacgactcactatagggtggctgaggcgatgtccctgttttagagctagaaatagcaagttaaaataaggctagtccgttatcaacttgaaaaagtggcaccgagtcggtgc

SEQ ID NO: 2519 - DNA, 23 bp, Artificial Sequence
  Description of Artificial Sequence: Synthetic oligonucleotide
tggctgaggcgatgtccctgggg

SEQ ID NO: 2520 - DNA, 119 bp, Artificial Sequence
  Description of Artificial Sequence: Synthetic polynucleotide
attctaatacgactcactataggtggctgaggcgatgtccctggttttagagctagaaatagcaagttaaaataaggctagtccgttatcaacttgaaaaagtggcaccgagtcggtgc

SEQ ID NO: 2521 - DNA, 23 bp, Artificial Sequence
  Description of Artificial Sequence: Synthetic oligonucleotide
tgaggcgatgtccctggggcggg

SEQ ID NO: 2522 - DNA, 119 bp, Artificial Sequence
  Description of Artificial Sequence: Synthetic polynucleotide
attctaatacgactcactataggtgaggcgatgtccctggggcgttttagagctagaaatagcaagttaaaataaggctagtccgttatcaacttgaaaaagtggcaccgagtcggtgc

SEQ ID NO: 2523 - DNA, 23 bp, Artificial Sequence
  Description of Artificial Sequence: Synthetic oligonucleotide
ggacatcgcctcagccaccgagg

SEQ ID NO: 2524 - DNA, 119 bp, Artificial Sequence
  Description of Artificial Sequence: Synthetic polynucleotide
attctaatacgactcactataggggacatcgcctcagccaccggttttagagctagaaatagcaagttaaaataaggctagtccgttatcaacttgaaaaagtggcaccgagtcggtgc

SEQ ID NO: 2525 - DNA, 23 bp, Artificial Sequence
  Description of Artificial Sequence: Synthetic oligonucleotide
gggcaaggtgggcggcctcttgg

SEQ ID NO: 2526 - DNA, 119 bp, Artificial Sequence
  Description of Artificial Sequence: Synthetic polynucleotide
attctaatacgactcactatagggggcaaggtgggcggcctctgttttagagctagaaatagcaagttaaaataaggctagtccgttatcaacttgaaaaagtggcaccgagtcggtgc

SEQ ID NO: 2527 - DNA, 23 bp, Artificial Sequence
  Description of Artificial Sequence: Synthetic oligonucleotide
ggcgtttggcgaaggccaagagg

SEQ ID NO: 2528 - DNA, 119 bp, Artificial Sequence
  Description of Artificial Sequence: Synthetic polynucleotide
attctaatacgactcactataggggcgtttggcgaaggccaaggttttagagctagaaatagcaagttaaaataaggctagtccgttatcaacttgaaaaagtggcaccgagtcggtgc

SEQ ID NO: 2529 - DNA, 23 bp, Artificial Sequence
  Description of Artificial Sequence: Synthetic oligonucleotide
gacgcagtgccagcgctgctagg

SEQ ID NO: 2530 - DNA, 119 bp, Artificial Sequence
  Description of Artificial Sequence: Synthetic polynucleotide
attctaatacgactcactatagggacgcagtgccagcgctgctgttttagagctagaaatagcaagttaaaataaggctagtccgttatcaacttgaaaaagtggcaccgagtcggtgc

SEQ ID NO: 2531 - DNA, 21 bp, Homo sapiens
ccagcgctgccagggcagcct

SEQ ID NO: 2532 - DNA, 21 bp, Artificial Sequence
  Description of Artificial Sequence: Synthetic oligonucleotide
ccagcgctgctagggcagcct

SEQ ID NO: 2533 - DNA, 23 bp, Artificial Sequence
  Description of Artificial Sequence: Synthetic oligonucleotide
ctgctagggcagcctgcacgagg

SEQ ID NO: 2534 - DNA, 119 bp, Artificial Sequence
  Description of Artificial Sequence: Synthetic polynucleotide
attctaatacgactcactataggctgctagggcagcctgcacggttttagagctagaaatagcaagttaaaataaggctagtccgttatcaacttgaaaaagtggcaccgagtcggtgc

SEQ ID NO: 2535 - DNA, 23 bp, Artificial Sequence
  Description of Artificial Sequence: Synthetic oligonucleotide
acgcagtgccagcgctgctaggg

SEQ ID NO: 2536 - DNA, 119 bp, Artificial Sequence
  Description of Artificial Sequence: Synthetic polynucleotide
attctaatacgactcactataggacgcagtgccagcgctgctagttttagagctagaaatagcaagttaaaataaggctagtccgttatcaacttgaaaaagtggcaccgagtcggtgc

SEQ ID NO: 2537 - DNA, 23 bp, Artificial Sequence
  Description of Artificial Sequence: Synthetic oligonucleotide
gcaggctgccctagcagcgctgg

SEQ ID NO: 2538 - DNA, 119 bp, Artificial Sequence
  Description of Artificial Sequence: Synthetic polynucleotide
attctaatacgactcactatagggcaggctgccctagcagcgcgttttagagctagaaatagcaagttaaaataaggctagtccgttatcaacttgaaaaagtggcaccgagtcggtgc

SEQ ID NO: 2539 - DNA, 23 bp, Artificial Sequence
  Description of Artificial Sequence: Synthetic oligonucleotide
gcccctcatctttcaacagttgg

SEQ ID NO: 2540 - DNA, 119 bp, Artificial Sequence
  Description of Artificial Sequence: Synthetic polynucleotide
attctaatacgactcactatagggcccctcatctttcaacagtgttttagagctagaaatagcaagttaaaataaggctagtccgttatcaacttgaaaaagtggcaccgagtcggtgc

SEQ ID NO: 2541 - DNA, 23 bp, Artificial Sequence
  Description of Artificial Sequence: Synthetic oligonucleotide
tctccaactgttgaaagatgagg

SEQ ID NO: 2542 - DNA, 119 bp, Artificial Sequence
  Description of Artificial Sequence: Synthetic polynucleotide
attctaatacgactcactataggtctccaactgttgaaagatggttttagagctagaaatagcaagttaaaataaggctagtccgttatcaacttgaaaaagtggcaccgagtcggtgc

SEQ ID NO: 2543 - DNA, 23 bp, Artificial Sequence
  Description of Artificial Sequence: Synthetic oligonucleotide
gaaagatgaggggctctgtctgg

SEQ ID NO: 2544 - DNA, 119 bp, Artificial Sequence
  Description of Artificial Sequence: Synthetic polynucleotide
attctaatacgactcactatagggaaagatgaggggctctgtcgttttagagctagaaatagcaagttaaaataaggctagtccgttatcaacttgaaaaagtggcaccgagtcggtgc

SEQ ID NO: 2545 - DNA, 23 bp, Artificial Sequence
  Description of Artificial Sequence: Synthetic oligonucleotide
ctccaactgttgaaagatgaggg

SEQ ID NO: 2546 - DNA, 119 bp, Artificial Sequence
  Description of Artificial Sequence: Synthetic polynucleotide
attctaatacgactcactataggctccaactgttgaaagatgagttttagagctagaaatagcaagttaaaataaggctagtccgttatcaacttgaaaaagtggcaccgagtcggtgc

SEQ ID NO: 2547 - DNA, 23 bp, Artificial Sequence
  Description of Artificial Sequence: Synthetic oligonucleotide
tccaactgttgaaagatgagggg

SEQ ID NO: 2548 - DNA, 119 bp, Artificial Sequence
  Description of Artificial Sequence: Synthetic polynucleotide
attctaatacgactcactataggtccaactgttgaaagatgaggttttagagctagaaatagcaagttaaaataaggctagtccgttatcaacttgaaaaagtggcaccgagtcggtgc

SEQ ID NO: 2549 - DNA, 23 bp, Artificial Sequence
  Description of Artificial Sequence: Synthetic oligonucleotide
aaagatgaggggctctgtctggg

SEQ ID NO: 2550 - DNA, 119 bp, Artificial Sequence
  Description of Artificial Sequence: Synthetic polynucleotide
attctaatacgactcactataggaaagatgaggggctctgtctgttttagagctagaaatagcaagttaaaataaggctagtccgttatcaacttgaaaaagtggcaccgagtcggtgc

SEQ ID NO: 2551 - DNA, 23 bp, Artificial Sequence
  Description of Artificial Sequence: Synthetic oligonucleotide
ctggttccaggtagctgaattgg

SEQ ID NO: 2552 - DNA, 119 bp, Artificial Sequence
  Description of Artificial Sequence: Synthetic polynucleotide
attctaatacgactcactataggctggttccaggtagctgaatgttttagagctagaaatagcaagttaaaataaggctagtccgttatcaacttgaaaaagtggcaccgagtcggtgc

SEQ ID NO: 2553 - DNA, 21 bp, Homo sapiens
ggtagctgaactgggccagag

SEQ ID NO: 2554 - DNA, 21 bp, Artificial Sequence
  Description of Artificial Sequence: Synthetic oligonucleotide
ggtagctgaattgggccagag

SEQ ID NO: 2555 - DNA, 23 bp, Artificial Sequence
  Description of Artificial Sequence: Synthetic oligonucleotide
tggttccaggtagctgaattggg

SEQ ID NO: 2556 - DNA, 119 bp, Artificial Sequence
  Description of Artificial Sequence: Synthetic polynucleotide
attctaatacgactcactataggtggttccaggtagctgaattgttttagagctagaaatagcaagttaaaataaggctagtccgttatcaacttgaaaaagtggcaccgagtcggtgc

SEQ ID NO: 2557 - DNA, 23 bp, Artificial Sequence
  Description of Artificial Sequence: Synthetic oligonucleotide
caattcagctacctggaaccagg

SEQ ID NO: 2558 - DNA, 119 bp, Artificial Sequence
  Description of Artificial Sequence: Synthetic polynucleotide
attctaatacgactcactataggcaattcagctacctggaaccgttttagagctagaaatagcaagttaaaataaggctagtccgttatcaacttgaaaaagtggcaccgagtcggtgc

SEQ ID NO: 2559 - DNA, 23 bp, Artificial Sequence
  Description of Artificial Sequence: Synthetic oligonucleotide
tctggcccaattcagctacctgg

SEQ ID NO: 2560 - DNA, 119 bp, Artificial Sequence
  Description of Artificial Sequence: Synthetic polynucleotide
attctaatacgactcactataggtctggcccaattcagctaccgttttagagctagaaatagcaagttaaaataaggctagtccgttatcaacttgaaaaagtggcaccgagtcggtgc

SEQ ID NO: 2561 - DNA, 23 bp, Artificial Sequence
  Description of Artificial Sequence: Synthetic oligonucleotide
ggaacttctctgactccacctgg

SEQ ID NO: 2562 - DNA, 119 bp, Artificial Sequence
  Description of Artificial Sequence: Synthetic polynucleotide
attctaatacgactcactataggggaacttctctgactccaccgttttagagctagaaatagcaagttaaaataaggctagtccgttatcaacttgaaaaagtggcaccgagtcggtgc

SEQ ID NO: 2563 - DNA, 21 bp, Homo sapiens
tctgactccagctggtgctgg

SEQ ID NO: 2564 - DNA, 21 bp, Artificial Sequence
  Description of Artificial Sequence: Synthetic oligonucleotide
tctgactccacctggtgctgg

SEQ ID NO: 2565 - DNA, 23 bp, Artificial Sequence
  Description of Artificial Sequence: Synthetic oligonucleotide
tctctgactccacctggtgctgg

SEQ ID NO: 2566 - DNA, 119 bp, Artificial Sequence
  Description of Artificial Sequence: Synthetic polynucleotide
attctaatacgactcactataggtctctgactccacctggtgcgttttagagctagaaatagcaagttaaaataaggctagtccgttatcaacttgaaaaagtggcaccgagtcggtgc

SEQ ID NO: 2567 - DNA, 23 bp, Artificial Sequence
  Description of Artificial Sequence: Synthetic oligonucleotide
ccacctggtgctggatccgatgg

SEQ ID NO: 2568 - DNA, 119 bp, Artificial Sequence
  Description of Artificial Sequence: Synthetic polynucleotide
attctaatacgactcactataggccacctggtgctggatccgagttttagagctagaaatagcaagttaaaataaggctagtccgttatcaacttgaaaaagtggcaccgagtcggtgc

SEQ ID NO: 2569 - DNA, 23 bp, Artificial Sequence
  Description of Artificial Sequence: Synthetic oligonucleotide
ccatcggatccagcaccaggtgg

SEQ ID NO: 2570 - DNA, 119 bp, Artificial Sequence
  Description of Artificial Sequence: Synthetic polynucleotide
attctaatacgactcactataggccatcggatccagcaccagggttttagagctagaaatagcaagttaaaataaggctagtccgttatcaacttgaaaaagtggcaccgagtcggtgc

SEQ ID NO: 2571 - DNA, 23 bp, Artificial Sequence
  Description of Artificial Sequence: Synthetic oligonucleotide
agcggcagggggctcggaactgg

SEQ ID NO: 2572 - DNA, 119 bp, Artificial Sequence
  Description of Artificial Sequence: Synthetic polynucleotide
attctaatacgactcactataggagcggcagggggctcggaacgttttagagctagaaatagcaagttaaaataaggctagtccgttatcaacttgaaaaagtggcaccgagtcggtgc

SEQ ID NO: 2573 - DNA, 21 bp, Homo sapiens
gcggcaggggtctcggaactg

SEQ ID NO: 2574 - DNA, 21 bp, Artificial Sequence
  Description of Artificial Sequence: Synthetic oligonucleotide
gcggcagggggctcggaactg

SEQ ID NO: 2575 - DNA, 23 bp, Artificial Sequence
  Description of Artificial Sequence: Synthetic oligonucleotide
cgtaggagcggcagggggctcgg

SEQ ID NO: 2576 - DNA, 119 bp, Artificial Sequence
  Description of Artificial Sequence: Synthetic polynucleotide
attctaatacgactcactataggcgtaggagcggcagggggctgttttagagctagaaatagcaagttaaaataaggctagtccgttatcaacttgaaaaagtggcaccgagtcggtgc

SEQ ID NO: 2577 - DNA, 23 bp, Artificial Sequence
  Description of Artificial Sequence: Synthetic oligonucleotide
ggctcggaactgggcctcctcgg

SEQ ID NO: 2578 - DNA, 119 bp, Artificial Sequence
  Description of Artificial Sequence: Synthetic polynucleotide
attctaatacgactcactataggggctcggaactgggcctcctgttttagagctagaaatagcaagttaaaataaggctagtccgttatcaacttgaaaaagtggcaccgagtcggtgc

SEQ ID NO: 2579 - DNA, 23 bp, Artificial Sequence
  Description of Artificial Sequence: Synthetic oligonucleotide
gcggcagggggctcggaactggg

SEQ ID NO: 2580 - DNA, 119 bp, Artificial Sequence
  Description of Artificial Sequence: Synthetic polynucleotide
attctaatacgactcactatagggcggcagggggctcggaactgttttagagctagaaatagcaagttaaaataaggctagtccgttatcaacttgaaaaagtggcaccgagtcggtgc

SEQ ID NO: 2581 - DNA, 23 bp, Artificial Sequence
  Description of Artificial Sequence: Synthetic oligonucleotide
atgcgccacttcctcagtttcgg

SEQ ID NO: 2582 - DNA, 119 bp, Artificial Sequence
  Description of Artificial Sequence: Synthetic polynucleotide
attctaatacgactcactataggatgcgccacttcctcagtttgttttagagctagaaatagcaagttaaaataaggctagtccgttatcaacttgaaaaagtggcaccgagtcggtgc

SEQ ID NO: 2583 - DNA, 23 bp, Artificial Sequence
  Description of Artificial Sequence: Synthetic oligonucleotide
aatggcttaagtctaagtagtgg

SEQ ID NO: 2584 - DNA, 119 bp, Artificial Sequence
  Description of Artificial Sequence: Synthetic polynucleotide
attctaatacgactcactataggaatggcttaagtctaagtaggttttagagctagaaatagcaagttaaaataaggctagtccgttatcaacttgaaaaagtggcaccgagtcggtgc

SEQ ID NO: 2585 - DNA, 21 bp, Homo sapiens
ggcttaagtcgaagtagtggt

SEQ ID NO: 2586 - DNA, 21 bp, Artificial Sequence
  Description of Artificial Sequence: Synthetic oligonucleotide
ggcttaagtctaagtagtggt

SEQ ID NO: 2587 - DNA, 23 bp, Artificial Sequence
  Description of Artificial Sequence: Synthetic oligonucleotide
ggggttcatcaagaagcagaagg

SEQ ID NO: 2588 - DNA, 119 bp, Artificial Sequence
  Description of Artificial Sequence: Synthetic polynucleotide
attctaatacgactcactataggggggttcatcaagaagcagagttttagagctagaaatagcaagttaaaataaggctagtccgttatcaacttgaaaaagtggcaccgagtcggtgc

SEQ ID NO: 2589 - DNA, 23 bp, Artificial Sequence
  Description of Artificial Sequence: Synthetic oligonucleotide
gggttcatcaagaagcagaaggg

SEQ ID NO: 2590 - DNA, 119 bp, Artificial Sequence
  Description of Artificial Sequence: Synthetic polynucleotide
attctaatacgactcactatagggggttcatcaagaagcagaagttttagagctagaaatagcaagttaaaataaggctagtccgttatcaacttgaaaaagtggcaccgagtcggtgc

SEQ ID NO: 2591 - DNA, 23 bp, Artificial Sequence
  Description of Artificial Sequence: Synthetic oligonucleotide
tgaacccccacaagtgctcccgg

SEQ ID NO: 2592 - DNA, 119 bp, Artificial Sequence
  Description of Artificial Sequence: Synthetic polynucleotide
attctaatacgactcactataggtgaacccccacaagtgctccgttttagagctagaaatagcaagttaaaataaggctagtccgttatcaacttgaaaaagtggcaccgagtcggtgc

SEQ ID NO: 2593 - DNA, 23 bp, Artificial Sequence
  Description of Artificial Sequence: Synthetic oligonucleotide
gaacccccacaagtgctcccggg

SEQ ID NO: 2594 - DNA, 119 bp, Artificial Sequence
  Description of Artificial Sequence: Synthetic polynucleotide
attctaatacgactcactatagggaacccccacaagtgctcccgttttagagctagaaatagcaagttaaaataaggctagtccgttatcaacttgaaaaagtggcaccgagtcggtgc

SEQ ID NO: 2595 - DNA, 23 bp, Artificial Sequence
  Description of Artificial Sequence: Synthetic oligonucleotide
tgatgaagatgatgtcctcctgg

SEQ ID NO: 2596 - DNA, 119 bp, Artificial Sequence
  Description of Artificial Sequence: Synthetic polynucleotide
attctaatacgactcactataggtgatgaagatgatgtcctccgttttagagctagaaatagcaagttaaaataaggctagtccgttatcaacttgaaaaagtggcaccgagtcggtgc

SEQ ID NO: 2597 - DNA, 21 bp, Homo sapiens
atgaagatgaggtcctcctgg

SEQ ID NO: 2598 - DNA, 21 bp, Artificial Sequence
  Description of Artificial Sequence: Synthetic oligonucleotide
atgaagatgatgtcctcctgg

SEQ ID NO: 2599 - DNA, 23 bp, Artificial Sequence
  Description of Artificial Sequence: Synthetic oligonucleotide
agatgatgtcctcctggccctgg

SEQ ID NO: 2600 - DNA, 119 bp, Artificial Sequence
  Description of Artificial Sequence: Synthetic polynucleotide
attctaatacgactcactataggagatgatgtcctcctggcccgttttagagctagaaatagcaagttaaaataaggctagtccgttatcaacttgaaaaagtggcaccgagtcggtgc

SEQ ID NO: 2601 - DNA, 23 bp, Artificial Sequence
  Description of Artificial Sequence: Synthetic oligonucleotide
gacatcatcttcatcatagatgg

SEQ ID NO: 2602 - DNA, 119 bp, Artificial Sequence
  Description of Artificial Sequence: Synthetic polynucleotide
attctaatacgactcactatagggacatcatcttcatcatagagttttagagctagaaatagcaagttaaaataaggctagtccgttatcaacttgaaaaagtggcaccgagtcggtgc

SEQ ID NO: 2603 - DNA, 23 bp, Artificial Sequence
  Description of Artificial Sequence: Synthetic oligonucleotide
gggagttgcaatggaaaaccagg

SEQ ID NO: 2604 - DNA, 119 bp, Artificial Sequence
  Description of Artificial Sequence: Synthetic polynucleotide
attctaatacgactcactatagggggagttgcaatggaaaaccgttttagagctagaaatagcaagttaaaataaggctagtccgttatcaacttgaaaaagtggcaccgagtcggtgc

SEQ ID NO: 2605 - DNA, 23 bp, Artificial Sequence
  Description of Artificial Sequence: Synthetic oligonucleotide
tcacgtggcgggagttgcaatgg

SEQ ID NO: 2606 - DNA, 119 bp, Artificial Sequence
  Description of Artificial Sequence: Synthetic polynucleotide
attctaatacgactcactataggtcacgtggcgggagttgcaagttttagagctagaaatagcaagttaaaataaggctagtccgttatcaacttgaaaaagtggcaccgagtcggtgc

SEQ ID NO: 2607 - DNA, 23 bp, Artificial Sequence
  Description of Artificial Sequence: Synthetic oligonucleotide
gttgcaatggaaaaccaggacgg

SEQ ID NO: 2608 - DNA, 119 bp, Artificial Sequence
  Description of Artificial Sequence: Synthetic polynucleotide
attctaatacgactcactatagggttgcaatggaaaaccaggagttttagagctagaaatagcaagttaaaataaggctagtccgttatcaacttgaaaaagtggcaccgagtcggtgc

SEQ ID NO: 2609 - DNA, 23 bp, Artificial Sequence
  Description of Artificial Sequence: Synthetic oligonucleotide
ttgcaatggaaaaccaggacggg

SEQ ID NO: 2610 - DNA, 119 bp, Artificial Sequence
  Description of Artificial Sequence: Synthetic polynucleotide
attctaatacgactcactataggttgcaatggaaaaccaggacgttttagagctagaaatagcaagttaaaataaggctagtccgttatcaacttgaaaaagtggcaccgagtcggtgc

SEQ ID NO: 2611 - DNA, 23 bp, Artificial Sequence
  Description of Artificial Sequence: Synthetic oligonucleotide
tgcaatggaaaaccaggacgggg

SEQ ID NO: 2612 - DNA, 119 bp, Artificial Sequence
  Description of Artificial Sequence: Synthetic polynucleotide
attctaatacgactcactataggtgcaatggaaaaccaggacggttttagagctagaaatagcaagttaaaataaggctagtccgttatcaacttgaaaaagtggcaccgagtcggtgc

SEQ ID NO: 2613 - DNA, 23 bp, Artificial Sequence
  Description of Artificial Sequence: Synthetic oligonucleotide
ggaggtggttgctatgcgacagg

SEQ ID NO: 2614 - DNA, 119 bp, Artificial Sequence
  Description of Artificial Sequence: Synthetic polynucleotide
attctaatacgactcactataggggaggtggttgctatgcgacgttttagagctagaaatagcaagttaaaataaggctagtccgttatcaacttgaaaaagtggcaccgagtcggtgc

SEQ ID NO: 2615 - DNA, 21 bp, Homo sapiens
cccctgtcgcttagcaaccac

SEQ ID NO: 2616 - DNA, 21 bp, Artificial Sequence
  Description of Artificial Sequence: Synthetic oligonucleotide
cccctgtcgcatagcaaccac

SEQ ID NO: 2617 - DNA, 23 bp, Artificial Sequence
  Description of Artificial Sequence: Synthetic oligonucleotide
tgctatgcgacagggggttccgg

SEQ ID NO: 2618 - DNA, 119 bp, Artificial Sequence
  Description of Artificial Sequence: Synthetic polynucleotide
attctaatacgactcactataggtgctatgcgacagggggttcgttttagagctagaaatagcaagttaaaataaggctagtccgttatcaacttgaaaaagtggcaccgagtcggtgc

SEQ ID NO: 2619 - DNA, 23 bp, Artificial Sequence
  Description of Artificial Sequence: Synthetic oligonucleotide
gaggtggttgctatgcgacaggg

SEQ ID NO: 2620 - DNA, 119 bp, Artificial Sequence
  Description of Artificial Sequence: Synthetic polynucleotide
attctaatacgactcactatagggaggtggttgctatgcgacagttttagagctagaaatagcaagttaaaataaggctagtccgttatcaacttgaaaaagtggcaccgagtcggtgc

SEQ ID NO: 2621 - DNA, 23 bp, Artificial Sequence
  Description of Artificial Sequence: Synthetic oligonucleotide
aggtggttgctatgcgacagggg

SEQ ID NO: 2622 - DNA, 119 bp, Artificial Sequence
  Description of Artificial Sequence: Synthetic polynucleotide
attctaatacgactcactataggaggtggttgctatgcgacaggttttagagctagaaatagcaagttaaaataaggctagtccgttatcaacttgaaaaagtggcaccgagtcggtgc

SEQ ID NO: 2623 - DNA, 23 bp, Artificial Sequence
  Description of Artificial Sequence: Synthetic oligonucleotide
ggtggttgctatgcgacaggggg

SEQ ID NO: 2624 - DNA, 119 bp, Artificial Sequence
  Description of Artificial Sequence: Synthetic polynucleotide
attctaatacgactcactataggggtggttgctatgcgacagggttttagagctagaaatagcaagttaaaataaggctagtccgttatcaacttgaaaaagtggcaccgagtcggtgc

SEQ ID NO: 2625 - DNA, 23 bp, Artificial Sequence
  Description of Artificial Sequence: Synthetic oligonucleotide
cactttgtttgaatttttgttgg

SEQ ID NO: 2626 - DNA, 119 bp, Artificial Sequence
  Description of Artificial Sequence: Synthetic polynucleotide
attctaatacgactcactataggcactttgtttgaatttttgtgttttagagctagaaatagcaagttaaaataaggctagtccgttatcaacttgaaaaagtggcaccgagtcggtgc

SEQ ID NO: 2627 - DNA, 23 bp, Artificial Sequence
  Description of Artificial Sequence: Synthetic oligonucleotide
actttgtttgaatttttgttggg

SEQ ID NO: 2628 - DNA, 119 bp, Artificial Sequence
  Description of Artificial Sequence: Synthetic polynucleotide
attctaatacgactcactataggactttgtttgaatttttgttgttttagagctagaaatagcaagttaaaataaggctagtccgttatcaacttgaaaaagtggcaccgagtcggtgc

SEQ ID NO: 2629 - DNA, 23 bp, Artificial Sequence
  Description of Artificial Sequence: Synthetic oligonucleotide
ctttgtttgaatttttgttgggg

SEQ ID NO: 2630 - DNA, 119 bp, Artificial Sequence
  Description of Artificial Sequence: Synthetic polynucleotide
attctaatacgactcactataggctttgtttgaatttttgttggttttagagctagaaatagcaagttaaaataaggctagtccgttatcaacttgaaaaagtggcaccgagtcggtgc

SEQ ID NO: 2631 - DNA, 23 bp, Artificial Sequence
  Description of Artificial Sequence: Synthetic oligonucleotide
tttgtttgaatttttgttggggg

SEQ ID NO: 2632 - DNA, 119 bp, Artificial Sequence
  Description of Artificial Sequence: Synthetic polynucleotide
attctaatacgactcactataggtttgtttgaatttttgttgggttttagagctagaaatagcaagttaaaataaggctagtccgttatcaacttgaaaaagtggcaccgagtcggtgc

SEQ ID NO: 2633 - DNA, 23 bp, Artificial Sequence
  Description of Artificial Sequence: Synthetic oligonucleotide
cctgcgcgctgggccgccggagg

SEQ ID NO: 2634 - DNA, 119 bp, Artificial Sequence
  Description of Artificial Sequence: Synthetic polynucleotide
attctaatacgactcactataggcctgcgcgctgggccgccgggttttagagctagaaatagcaagttaaaataaggctagtccgttatcaacttgaaaaagtggcaccgagtcggtgc

SEQ ID NO: 2635 - DNA, 21 bp, Homo sapiens
taaaaaccccggcgcgctggg

SEQ ID NO: 2636 - DNA, 21 bp, Artificial Sequence
  Description of Artificial Sequence: Synthetic oligonucleotide
taaaaacccctgcgcgctggg

SEQ ID NO: 2637 - DNA, 23 bp, Artificial Sequence
  Description of Artificial Sequence: Synthetic oligonucleotide
gtgtaaaaacccctgcgcgctgg

SEQ ID NO: 2638 - DNA, 119 bp, Artificial Sequence
  Description of Artificial Sequence: Synthetic polynucleotide
attctaatacgactcactatagggtgtaaaaacccctgcgcgcgttttagagctagaaatagcaagttaaaataaggctagtccgttatcaacttgaaaaagtggcaccgagtcggtgc

SEQ ID NO: 2639 - DNA, 23 bp, Artificial Sequence
  Description of Artificial Sequence: Synthetic oligonucleotide
acccctgcgcgctgggccgccgg

SEQ ID NO: 2640 - DNA, 119 bp, Artificial Sequence
  Description of Artificial Sequence: Synthetic polynucleotide
attctaatacgactcactataggacccctgcgcgctgggccgcgttttagagctagaaatagcaagttaaaataaggctagtccgttatcaacttgaaaaagtggcaccgagtcggtgc

SEQ ID NO: 2641 - DNA, 23 bp, Artificial Sequence
  Description of Artificial Sequence: Synthetic oligonucleotide
tgtaaaaacccctgcgcgctggg

SEQ ID NO: 2642 - DNA, 119 bp, Artificial Sequence
  Description of Artificial Sequence: Synthetic polynucleotide
attctaatacgactcactataggtgtaaaaacccctgcgcgctgttttagagctagaaatagcaagttaaaataaggctagtccgttatcaacttgaaaaagtggcaccgagtcggtgc

SEQ ID NO: 2643 - DNA, 23 bp, Artificial Sequence
  Description of Artificial Sequence: Synthetic oligonucleotide
cctccggcggcccagcgcgcagg

SEQ ID NO: 2644 - DNA, 119 bp, Artificial Sequence
  Description of Artificial Sequence: Synthetic polynucleotide
attctaatacgactcactataggcctccggcggcccagcgcgcgttttagagctagaaatagcaagttaaaataaggctagtccgttatcaacttgaaaaagtggcaccgagtcggtgc

SEQ ID NO: 2645 - DNA, 23 bp, Artificial Sequence
  Description of Artificial Sequence: Synthetic oligonucleotide
ctccggcggcccagcgcgcaggg

SEQ ID NO: 2646 - DNA, 119 bp, Artificial Sequence
  Description of Artificial Sequence: Synthetic polynucleotide
attctaatacgactcactataggctccggcggcccagcgcgcagttttagagctagaaatagcaagttaaaataaggctagtccgttatcaacttgaaaaagtggcaccgagtcggtgc

SEQ ID NO: 2647 - DNA, 23 bp, Artificial Sequence
  Description of Artificial Sequence: Synthetic oligonucleotide
tccggcggcccagcgcgcagggg

SEQ ID NO: 2648 - DNA, 119 bp, Artificial Sequence
  Description of Artificial Sequence: Synthetic polynucleotide
attctaatacgactcactataggtccggcggcccagcgcgcaggttttagagctagaaatagcaagttaaaataaggctagtccgttatcaacttgaaaaagtggcaccgagtcggtgc

SEQ ID NO: 2649 - DNA, 23 bp, Artificial Sequence
  Description of Artificial Sequence: Synthetic oligonucleotide
aaaaaaatgcggcaagttcttgg

SEQ ID NO: 2650 - DNA, 119 bp, Artificial Sequence
  Description of Artificial Sequence: Synthetic polynucleotide
attctaatacgactcactataggaaaaaaatgcggcaagttctgttttagagctagaaatagcaagttaaaataaggctagtccgttatcaacttgaaaaagtggcaccgagtcggtgc

SEQ ID NO: 2651 - DNA, 23 bp, Artificial Sequence
  Description of Artificial Sequence: Synthetic oligonucleotide
atgcggcaagttcttggttgtgg

SEQ ID NO: 2652 - DNA, 119 bp, Artificial Sequence
  Description of Artificial Sequence: Synthetic polynucleotide
attctaatacgactcactataggatgcggcaagttcttggttggttttagagctagaaatagcaagttaaaataaggctagtccgttatcaacttgaaaaagtggcaccgagtcggtgc

SEQ ID NO: 2653 - DNA, 23 bp, Artificial Sequence
  Description of Artificial Sequence: Synthetic oligonucleotide
ttgttacattcaaaaaaatgcgg

SEQ ID NO: 2654 - DNA, 119 bp, Artificial Sequence
  Description of Artificial Sequence: Synthetic polynucleotide
attctaatacgactcactataggttgttacattcaaaaaaatggttttagagctagaaatagcaagttaaaataaggctagtccgttatcaacttgaaaaagtggcaccgagtcggtgc

SEQ ID NO: 2655 - DNA, 23 bp, Artificial Sequence
  Description of Artificial Sequence: Synthetic oligonucleotide
agtaagaaccagagacaaaaagg

SEQ ID NO: 2656 - DNA, 119 bp, Artificial Sequence
  Description of Artificial Sequence: Synthetic polynucleotide
attctaatacgactcactataggagtaagaaccagagacaaaagttttagagctagaaatagcaagttaaaataaggctagtccgttatcaacttgaaaaagtggcaccgagtcggtgc

SEQ ID NO: 2657 - DNA, 23 bp, Artificial Sequence
  Description of Artificial Sequence: Synthetic oligonucleotide
cacatcaagattcagagcactgg

SEQ ID NO: 2658 - DNA, 119 bp, Artificial Sequence
  Description of Artificial Sequence: Synthetic polynucleotide
attctaatacgactcactataggcacatcaagattcagagcacgttttagagctagaaatagcaagttaaaataaggctagtccgttatcaacttgaaaaagtggcaccgagtcggtgc

SEQ ID NO: 2659 - DNA, 21 bp, Homo sapiens
aagattcagaacactggtgat

SEQ ID NO: 2660 - DNA, 21 bp, Artificial Sequence
  Description of Artificial Sequence: Synthetic oligonucleotide
aagattcagagcactggtgat

SEQ ID NO: 2661 - DNA, 23 bp, Artificial Sequence
  Description of Artificial Sequence: Synthetic oligonucleotide
cagtgctctgaatcttgatgtgg

SEQ ID NO: 2662 - DNA, 119 bp, Artificial Sequence
  Description of Artificial Sequence: Synthetic polynucleotide
attctaatacgactcactataggcagtgctctgaatcttgatggttttagagctagaaatagcaagttaaaataaggctagtccgttatcaacttgaaaaagtggcaccgagtcggtgc

SEQ ID NO: 2663 - DNA, 23 bp, Artificial Sequence
  Description of Artificial Sequence: Synthetic oligonucleotide
agtgctctgaatcttgatgtggg

SEQ ID NO: 2664 - DNA, 119 bp, Artificial Sequence
  Description of Artificial Sequence: Synthetic polynucleotide
attctaatacgactcactataggagtgctctgaatcttgatgtgttttagagctagaaatagcaagttaaaataaggctagtccgttatcaacttgaaaaagtggcaccgagtcggtgc

SEQ ID NO: 2665 - DNA, 23 bp, Artificial Sequence
  Description of Artificial Sequence: Synthetic oligonucleotide
cgttgtcatgacaatcactcagg

SEQ ID NO: 2666 - DNA, 119 bp, Artificial Sequence
  Description of Artificial Sequence: Synthetic polynucleotide
attctaatacgactcactataggcgttgtcatgacaatcactcgttttagagctagaaatagcaagttaaaataaggctagtccgttatcaacttgaaaaagtggcaccgagtcggtgc

SEQ ID NO: 2667 - DNA, 23 bp, Artificial Sequence
  Description of Artificial Sequence: Synthetic oligonucleotide
caatcactcaggagttttcttgg

SEQ ID NO: 2668 - DNA, 119 bp, Artificial Sequence
  Description of Artificial Sequence: Synthetic polynucleotide
attctaatacgactcactataggcaatcactcaggagttttctgttttagagctagaaatagcaagttaaaataaggctagtccgttatcaacttgaaaaagtggcaccgagtcggtgc

SEQ ID NO: 2669 - DNA, 23 bp, Artificial Sequence
  Description of Artificial Sequence: Synthetic oligonucleotide
acaggagttcctggaggtttagg

SEQ ID NO: 2670 - DNA, 119 bp, Artificial Sequence
  Description of Artificial Sequence: Synthetic polynucleotide
attctaatacgactcactataggacaggagttcctggaggtttgttttagagctagaaatagcaagttaaaataaggctagtccgttatcaacttgaaaaagtggcaccgagtcggtgc

SEQ ID NO: 2671 - DNA, 23 bp, Artificial Sequence
  Description of Artificial Sequence: Synthetic oligonucleotide
agttcctggaggtttaggtaagg

SEQ ID NO: 2672 - DNA, 119 bp, Artificial Sequence
  Description of Artificial Sequence: Synthetic polynucleotide
attctaatacgactcactataggagttcctggaggtttaggtagttttagagctagaaatagcaagttaaaataaggctagtccgttatcaacttgaaaaagtggcaccgagtcggtgc

SEQ ID NO: 2673 - DNA, 23 bp, Artificial Sequence
  Description of Artificial Sequence: Synthetic oligonucleotide
ctggaggtttaggtaaggcttgg

SEQ ID NO: 2674 - DNA, 119 bp, Artificial Sequence
  Description of Artificial Sequence: Synthetic polynucleotide
attctaatacgactcactataggctggaggtttaggtaaggctgttttagagctagaaatagcaagttaaaataaggctagtccgttatcaacttgaaaaagtggcaccgagtcggtgc

SEQ ID NO: 2675 - DNA, 23 bp, Artificial Sequence
  Description of Artificial Sequence: Synthetic oligonucleotide
aggtttaggtaaggcttggatgg

SEQ ID NO: 2676 - DNA, 119 bp, Artificial Sequence
  Description of Artificial Sequence: Synthetic polynucleotide
attctaatacgactcactataggaggtttaggtaaggcttggagttttagagctagaaatagcaagttaaaataaggctagtccgttatcaacttgaaaaagtggcaccgagtcggtgc

SEQ ID NO: 2677 - DNA, 23 bp, Artificial Sequence
  Description of Artificial Sequence: Synthetic oligonucleotide
ggtttaggtaaggcttggatggg

SEQ ID NO: 2678 - DNA, 119 bp, Artificial Sequence
  Description of Artificial Sequence: Synthetic polynucleotide
attctaatacgactcactataggggtttaggtaaggcttggatgttttagagctagaaatagcaagttaaaataaggctagtccgttatcaacttgaaaaagtggcaccgagtcggtgc

SEQ ID NO: 2679 - DNA, 23 bp, Artificial Sequence
  Description of Artificial Sequence: Synthetic oligonucleotide
gtttaggtaaggcttggatgggg

SEQ ID NO: 2680 - DNA, 119 bp, Artificial Sequence
  Description of Artificial Sequence: Synthetic polynucleotide
attctaatacgactcactatagggtttaggtaaggcttggatggttttagagctagaaatagcaagttaaaataaggctagtccgttatcaacttgaaaaagtggcaccgagtcggtgc

SEQ ID NO: 2681 - DNA, 23 bp, Artificial Sequence
  Description of Artificial Sequence: Synthetic oligonucleotide
tttaggtaaggcttggatggggg

SEQ ID NO: 2682 - DNA, 119 bp, Artificial Sequence
  Description of Artificial Sequence: Synthetic polynucleotide
attctaatacgactcactataggtttaggtaaggcttggatgggttttagagctagaaatagcaagttaaaataaggctagtccgttatcaacttgaaaaagtggcaccgagtcggtgc

SEQ ID NO: 2683 - DNA, 23 bp, Artificial Sequence
  Description of Artificial Sequence: Synthetic oligonucleotide
caagccttacctaaacctccagg

SEQ ID NO: 2684 - DNA, 119 bp, Artificial Sequence
  Description of Artificial Sequence: Synthetic polynucleotide
attctaatacgactcactataggcaagccttacctaaacctccgttttagagctagaaatagcaagttaaaataaggctagtccgttatcaacttgaaaaagtggcaccgagtcggtgc

SEQ ID NO: 2685 - DNA, 23 bp, Artificial Sequence
  Description of Artificial Sequence: Synthetic oligonucleotide
ttacatgaatgccaactacgtgg

SEQ ID NO: 2686 - DNA, 119 bp, Artificial Sequence
  Description of Artificial Sequence: Synthetic polynucleotide
attctaatacgactcactataggttacatgaatgccaactacggttttagagctagaaatagcaagttaaaataaggctagtccgttatcaacttgaaaaagtggcaccgagtcggtgc

SEQ ID NO: 2687 - DNA, 21 bp, Homo sapiens
agttggcattgatgtaatcac

SEQ ID NO: 2688 - DNA, 21 bp, Artificial Sequence
  Description of Artificial Sequence: Synthetic oligonucleotide
agttggcattcatgtaatcac

SEQ ID NO: 2689 - DNA, 23 bp, Artificial Sequence
  Description of Artificial Sequence: Synthetic oligonucleotide
atgaatgccaactacgtggacgg

SEQ ID NO: 2690 - DNA, 119 bp, Artificial Sequence
  Description of Artificial Sequence: Synthetic polynucleotide
attctaatacgactcactataggatgaatgccaactacgtggagttttagagctagaaatagcaagttaaaataaggctagtccgttatcaacttgaaaaagtggcaccgagtcggtgc

SEQ ID NO: 2691 - DNA, 23 bp, Artificial Sequence
  Description of Artificial Sequence: Synthetic oligonucleotide
cgtctcacacacactgcagatgg

SEQ ID NO: 2692 - DNA, 119 bp, Artificial Sequence
  Description of Artificial Sequence: Synthetic polynucleotide
attctaatacgactcactataggcgtctcacacacactgcagagttttagagctagaaatagcaagttaaaataaggctagtccgttatcaacttgaaaaagtggcaccgagtcggtgc

SEQ ID NO: 2693 - DNA, 23 bp, Artificial Sequence
  Description of Artificial Sequence: Synthetic oligonucleotide
cacggggtgtcacaatgtttagg

SEQ ID NO: 2694 - DNA, 119 bp, Artificial Sequence
  Description of Artificial Sequence: Synthetic polynucleotide
attctaatacgactcactataggcacggggtgtcacaatgtttgttttagagctagaaatagcaagttaaaataaggctagtccgttatcaacttgaaaaagtggcaccgagtcggtgc

SEQ ID NO: 2695 - DNA, 23 bp, Artificial Sequence
  Description of Artificial Sequence: Synthetic oligonucleotide
ttagggtctgtggggcacaaagg

SEQ ID NO: 2696 - DNA, 119 bp, Artificial Sequence
  Description of Artificial Sequence: Synthetic polynucleotide
attctaatacgactcactataggttagggtctgtggggcacaagttttagagctagaaatagcaagttaaaataaggctagtccgttatcaacttgaaaaagtggcaccgagtcggtgc

SEQ ID NO: 2697 - DNA, 23 bp, Artificial Sequence
  Description of Artificial Sequence: Synthetic oligonucleotide
gtcacaatgtttagggtctgtgg

SEQ ID NO: 2698 - DNA, 119 bp, Artificial Sequence
  Description of Artificial Sequence: Synthetic polynucleotide
attctaatacgactcactatagggtcacaatgtttagggtctggttttagagctagaaatagcaagttaaaataaggctagtccgttatcaacttgaaaaagtggcaccgagtcggtgc

SEQ ID NO: 2699 - DNA, 23 bp, Artificial Sequence
  Description of Artificial Sequence: Synthetic oligonucleotide
acggggtgtcacaatgtttaggg

SEQ ID NO: 2700 - DNA, 119 bp, Artificial Sequence
  Description of Artificial Sequence: Synthetic polynucleotide
attctaatacgactcactataggacggggtgtcacaatgtttagttttagagctagaaatagcaagttaaaataaggctagtccgttatcaacttgaaaaagtggcaccgagtcggtgc

SEQ ID NO: 2701 - DNA, 23 bp, Artificial Sequence
  Description of Artificial Sequence: Synthetic oligonucleotide
tcacaatgtttagggtctgtggg

SEQ ID NO: 2702 - DNA, 119 bp, Artificial Sequence
  Description of Artificial Sequence: Synthetic polynucleotide
attctaatacgactcactataggtcacaatgtttagggtctgtgttttagagctagaaatagcaagttaaaataaggctagtccgttatcaacttgaaaaagtggcaccgagtcggtgc

SEQ ID NO: 2703 - DNA, 23 bp, Artificial Sequence
  Description of Artificial Sequence: Synthetic oligonucleotide
cacaatgtttagggtctgtgggg

SEQ ID NO: 2704 - DNA, 119 bp, Artificial Sequence
  Description of Artificial Sequence: Synthetic polynucleotide
attctaatacgactcactataggcacaatgtttagggtctgtggttttagagctagaaatagcaagttaaaataaggctagtccgttatcaacttgaaaaagtggcaccgagtcggtgc

SEQ ID NO: 2705 - DNA, 23 bp, Artificial Sequence
  Description of Artificial Sequence: Synthetic oligonucleotide
acaaagtcatgaaattcttcagg

SEQ ID NO: 2706 - DNA, 119 bp, Artificial Sequence
  Description of Artificial Sequence: Synthetic polynucleotide
attctaatacgactcactataggacaaagtcatgaaattcttcgttttagagctagaaatagcaagttaaaataaggctagtccgttatcaacttgaaaaagtggcaccgagtcggtgc

SEQ ID NO: 2707 - DNA, 23 bp, Artificial Sequence
  Description of Artificial Sequence: Synthetic oligonucleotide
gtgactggtctcagttatcgagg

SEQ ID NO: 2708 - DNA, 119 bp, Artificial Sequence
  Description of Artificial Sequence: Synthetic polynucleotide
attctaatacgactcactatagggtgactggtctcagttatcggttttagagctagaaatagcaagttaaaataaggctagtccgttatcaacttgaaaaagtggcaccgagtcggtgc

SEQ ID NO: 2709 - DNA, 21 bp, Homo sapiens
tgactggtctgagttatcgag

SEQ ID NO: 2710 - DNA, 21 bp, Artificial Sequence
  Description of Artificial Sequence: Synthetic oligonucleotide
tgactggtctcagttatcgag

SEQ ID NO: 2711 - DNA, 23 bp, Artificial Sequence
  Description of Artificial Sequence: Synthetic oligonucleotide
cagatccggccaccccctaatgg

SEQ ID NO: 2712 - DNA, 119 bp, Artificial Sequence
  Description of Artificial Sequence: Synthetic polynucleotide
attctaatacgactcactataggcagatccggccaccccctaagttttagagctagaaatagcaagttaaaataaggctagtccgttatcaacttgaaaaagtggcaccgagtcggtgc

SEQ ID NO: 2713 - DNA, 21 bp, Homo sapiens
gccaccccctgatggttctga

SEQ ID NO: 2714 - DNA, 21 bp, Artificial Sequence
  Description of Artificial Sequence: Synthetic oligonucleotide
gccaccccctaatggttctga

SEQ ID NO: 2715 - DNA, 23 bp, Artificial Sequence
  Description of Artificial Sequence: Synthetic oligonucleotide
gaagtgcagtcagaaccattagg

SEQ ID NO: 2716 - DNA, 119 bp, Artificial Sequence
  Description of Artificial Sequence: Synthetic polynucleotide
attctaatacgactcactatagggaagtgcagtcagaaccattgttttagagctagaaatagcaagttaaaataaggctagtccgttatcaacttgaaaaagtggcaccgagtcggtgc

SEQ ID NO: 2717 - DNA, 23 bp, Artificial Sequence
  Description of Artificial Sequence: Synthetic oligonucleotide
cagtcagaaccattagggggtgg

SEQ ID NO: 2718 - DNA, 119 bp, Artificial Sequence
  Description of Artificial Sequence: Synthetic polynucleotide
attctaatacgactcactataggcagtcagaaccattaggggggttttagagctagaaatagcaagttaaaataaggctagtccgttatcaacttgaaaaagtggcaccgagtcggtgc

SEQ ID NO: 2719 - DNA, 23 bp, Artificial Sequence
  Description of Artificial Sequence: Synthetic oligonucleotide
cagaaccattagggggtggccgg

SEQ ID NO: 2720 - DNA, 119 bp, Artificial Sequence
  Description of Artificial Sequence: Synthetic polynucleotide
attctaatacgactcactataggcagaaccattagggggtggcgttttagagctagaaatagcaagttaaaataaggctagtccgttatcaacttgaaaaagtggcaccgagtcggtgc

SEQ ID NO: 2721 - DNA, 23 bp, Artificial Sequence
  Description of Artificial Sequence: Synthetic oligonucleotide
tagggggtggccggatctgacgg

SEQ ID NO: 2722 - DNA, 119 bp, Artificial Sequence
  Description of Artificial Sequence: Synthetic polynucleotide
attctaatacgactcactataggtagggggtggccggatctgagttttagagctagaaatagcaagttaaaataaggctagtccgttatcaacttgaaaaagtggcaccgagtcggtgc

SEQ ID NO: 2723 - DNA, 23 bp, Artificial Sequence
  Description of Artificial Sequence: Synthetic oligonucleotide
aagtgcagtcagaaccattaggg

SEQ ID NO: 2724 - DNA, 119 bp, Artificial Sequence
  Description of Artificial Sequence: Synthetic polynucleotide
attctaatacgactcactataggaagtgcagtcagaaccattagttttagagctagaaatagcaagttaaaataaggctagtccgttatcaacttgaaaaagtggcaccgagtcggtgc

SEQ ID NO: 2725 - DNA, 23 bp, Artificial Sequence
  Description of Artificial Sequence: Synthetic oligonucleotide
agtgcagtcagaaccattagggg

SEQ ID NO: 2726 - DNA, 119 bp, Artificial Sequence
  Description of Artificial Sequence: Synthetic polynucleotide
attctaatacgactcactataggagtgcagtcagaaccattaggttttagagctagaaatagcaagttaaaataaggctagtccgttatcaacttgaaaaagtggcaccgagtcggtgc

SEQ ID NO: 2727 - DNA, 23 bp, Artificial Sequence
  Description of Artificial Sequence: Synthetic oligonucleotide
gtgcagtcagaaccattaggggg

SEQ ID NO: 2728 - DNA, 119 bp, Artificial Sequence
  Description of Artificial Sequence: Synthetic polynucleotide
attctaatacgactcactatagggtgcagtcagaaccattagggttttagagctagaaatagcaagttaaaataaggctagtccgttatcaacttgaaaaagtggcaccgagtcggtgc

SEQ ID NO: 2729 - DNA, 23 bp, Artificial Sequence
  Description of Artificial Sequence: Synthetic oligonucleotide
tgatctggtcggtgatggtgagg

SEQ ID NO: 2730 - DNA, 119 bp, Artificial Sequence
  Description of Artificial Sequence: Synthetic polynucleotide
attctaatacgactcactataggtgatctggtcggtgatggtggttttagagctagaaatagcaagttaaaataaggctagtccgttatcaacttgaaaaagtggcaccgagtcggtgc

SEQ ID NO: 2731 - DNA, 21 bp, Homo sapiens
cctcaccatcgccgaccagat

SEQ ID NO: 2732 - DNA, 21 bp, Artificial Sequence
  Description of Artificial Sequence: Synthetic oligonucleotide
cctcaccatcaccgaccagat

SEQ ID NO: 2733 - DNA, 23 bp, Artificial Sequence
  Description of Artificial Sequence: Synthetic oligonucleotide
gagggtgatctggtcggtgatgg

SEQ ID NO: 2734 - DNA, 119 bp, Artificial Sequence
  Description of Artificial Sequence: Synthetic polynucleotide
attctaatacgactcactatagggagggtgatctggtcggtgagttttagagctagaaatagcaagttaaaataaggctagtccgttatcaacttgaaaaagtggcaccgagtcggtgc

SEQ ID NO: 2735 - DNA, 23 bp, Artificial Sequence
  Description of Artificial Sequence: Synthetic oligonucleotide
ctggtcggtgatggtgagggtgg

SEQ ID NO: 2736 - DNA, 119 bp, Artificial Sequence
  Description of Artificial Sequence: Synthetic polynucleotide
attctaatacgactcactataggctggtcggtgatggtgaggggttttagagctagaaatagcaagttaaaataaggctagtccgttatcaacttgaaaaagtggcaccgagtcggtgc

SEQ ID NO: 2737 - DNA, 23 bp, Artificial Sequence
  Description of Artificial Sequence: Synthetic oligonucleotide
gatctggtcggtgatggtgaggg

SEQ ID NO: 2738 - DNA, 119 bp, Artificial Sequence
  Description of Artificial Sequence: Synthetic polynucleotide
attctaatacgactcactatagggatctggtcggtgatggtgagttttagagctagaaatagcaagttaaaataaggctagtccgttatcaacttgaaaaagtggcaccgagtcggtgc

SEQ ID NO: 2739 - DNA, 23 bp, Artificial Sequence
  Description of Artificial Sequence: Synthetic oligonucleotide
tcttcgcgagtatggcagccagg

SEQ ID NO: 2740 - DNA, 119 bp, Artificial Sequence
  Description of Artificial Sequence: Synthetic polynucleotide
attctaatacgactcactataggtcttcgcgagtatggcagccgttttagagctagaaatagcaagttaaaataaggctagtccgttatcaacttgaaaaagtggcaccgagtcggtgc

SEQ ID NO: 2741 - DNA, 21 bp, Homo sapiens
cgttcatatcctcgcgagtat

SEQ ID NO: 2742 - DNA, 21 bp, Artificial Sequence
  Description of Artificial Sequence: Synthetic oligonucleotide
cgttcatatcttcgcgagtat

SEQ ID NO: 2743 - DNA, 23 bp, Artificial Sequence
  Description of Artificial Sequence: Synthetic oligonucleotide
cgttcatatcttcgcgagtatgg

SEQ ID NO: 2744 - DNA, 119 bp, Artificial Sequence
  Description of Artificial Sequence: Synthetic polynucleotide
attctaatacgactcactataggcgttcatatcttcgcgagtagttttagagctagaaatagcaagttaaaataaggctagtccgttatcaacttgaaaaagtggcaccgagtcggtgc

SEQ ID NO: 2745 - DNA, 23 bp, Artificial Sequence
  Description of Artificial Sequence: Synthetic oligonucleotide
catactcgcgaagatatgaacgg

SEQ ID NO: 2746 - DNA, 119 bp, Artificial Sequence
  Description of Artificial Sequence: Synthetic polynucleotide
attctaatacgactcactataggcatactcgcgaagatatgaagttttagagctagaaatagcaagttaaaataaggctagtccgttatcaacttgaaaaagtggcaccgagtcggtgc

SEQ ID NO: 2747 - DNA, 23 bp, Artificial Sequence
  Description of Artificial Sequence: Synthetic oligonucleotide
tgcgccgtacttcctcctcttgg

SEQ ID NO: 2748 - DNA, 119 bp, Artificial Sequence
  Description of Artificial Sequence: Synthetic polynucleotide
attctaatacgactcactataggtgcgccgtacttcctcctctgttttagagctagaaatagcaagttaaaataaggctagtccgttatcaacttgaaaaagtggcaccgagtcggtgc

SEQ ID NO: 2749 - DNA, 21 bp, Homo sapiens
gaagtacggcggcatatccac

SEQ ID NO: 2750 - DNA, 20 bp, Artificial Sequence
  Description of Artificial Sequence: Synthetic oligonucleotide
gaagtacggcgcatatccac

SEQ ID NO: 2751 - DNA, 23 bp, Artificial Sequence
  Description of Artificial Sequence: Synthetic oligonucleotide
gcgccgtacttcctcctcttggg

SEQ ID NO: 2752 - DNA, 119 bp, Artificial Sequence
  Description of Artificial Sequence: Synthetic polynucleotide
attctaatacgactcactatagggcgccgtacttcctcctcttgttttagagctagaaatagcaagttaaaataaggctagtccgttatcaacttgaaaaagtggcaccgagtcggtgc

SEQ ID NO: 2753 - DNA, 23 bp, Artificial Sequence
  Description of Artificial Sequence: Synthetic oligonucleotide
ggaattccctcggaagagcttgg

SEQ ID NO: 2754 - DNA, 119 bp, Artificial Sequence
  Description of Artificial Sequence: Synthetic polynucleotide
attctaatacgactcactataggggaattccctcggaagagctgttttagagctagaaatagcaagttaaaataaggctagtccgttatcaacttgaaaaagtggcaccgagtcggtgc

SEQ ID NO: 2755 - DNA, 23 bp, Artificial Sequence
  Description of Artificial Sequence: Synthetic oligonucleotide
cctcggaagagcttggttcttgg

SEQ ID NO: 2756 - DNA, 119 bp, Artificial Sequence
  Description of Artificial Sequence: Synthetic polynucleotide
attctaatacgactcactataggcctcggaagagcttggttctgttttagagctagaaatagcaagttaaaataaggctagtccgttatcaacttgaaaaagtggcaccgagtcggtgc

SEQ ID NO: 2757 - DNA, 23 bp, Artificial Sequence
  Description of Artificial Sequence: Synthetic oligonucleotide
ccaagaaccaagctcttccgagg

SEQ ID NO: 2758 - DNA, 119 bp, Artificial Sequence
  Description of Artificial Sequence: Synthetic polynucleotide
attctaatacgactcactataggccaagaaccaagctcttccggttttagagctagaaatagcaagttaaaataaggctagtccgttatcaacttgaaaaagtggcaccgagtcggtgc

SEQ ID NO: 2759 - DNA, 23 bp, Artificial Sequence
  Description of Artificial Sequence: Synthetic oligonucleotide
caagaaccaagctcttccgaggg

SEQ ID NO: 2760 - DNA, 119 bp, Artificial Sequence
  Description of Artificial Sequence: Synthetic polynucleotide
attctaatacgactcactataggcaagaaccaagctcttccgagttttagagctagaaatagcaagttaaaataaggctagtccgttatcaacttgaaaaagtggcaccgagtcggtgc

SEQ ID NO: 2761 - DNA, 23 bp, Artificial Sequence
  Description of Artificial Sequence: Synthetic oligonucleotide
cggtgctccccggggacacctgg

SEQ ID NO: 2762 - DNA, 119 bp, Artificial Sequence
  Description of Artificial Sequence: Synthetic polynucleotide
attctaatacgactcactataggcggtgctccccggggacaccgttttagagctagaaatagcaagttaaaataaggctagtccgttatcaacttgaaaaagtggcaccgagtcggtgc

SEQ ID NO: 2763 - DNA, 21 bp, Homo sapiens
cacaagcacgctgctccccgg

SEQ ID NO: 2764 - DNA, 21 bp, Artificial Sequence
  Description of Artificial Sequence: Synthetic oligonucleotide
cacaagcacggtgctccccgg

SEQ ID NO: 2765 - DNA, 23 bp, Artificial Sequence
  Description of Artificial Sequence: Synthetic oligonucleotide
tacacaagcacggtgctccccgg

SEQ ID NO: 2766 - DNA, 119 bp, Artificial Sequence
  Description of Artificial Sequence: Synthetic polynucleotide
attctaatacgactcactataggtacacaagcacggtgctcccgttttagagctagaaatagcaagttaaaataaggctagtccgttatcaacttgaaaaagtggcaccgagtcggtgc

SEQ ID NO: 2767 - DNA, 23 bp, Artificial Sequence
  Description of Artificial Sequence: Synthetic oligonucleotide
acacaagcacggtgctccccggg

SEQ ID NO: 2768 - DNA, 119 bp, Artificial Sequence
  Description of Artificial Sequence: Synthetic polynucleotide
attctaatacgactcactataggacacaagcacggtgctccccgttttagagctagaaatagcaagttaaaataaggctagtccgttatcaacttgaaaaagtggcaccgagtcggtgc

SEQ ID NO: 2769 - DNA, 23 bp, Artificial Sequence
  Description of Artificial Sequence: Synthetic oligonucleotide
cacaagcacggtgctccccgggg

SEQ ID NO: 2770 - DNA, 119 bp, Artificial Sequence
  Description of Artificial Sequence: Synthetic polynucleotide
attctaatacgactcactataggcacaagcacggtgctccccggttttagagctagaaatagcaagttaaaataaggctagtccgttatcaacttgaaaaagtggcaccgagtcggtgc

SEQ ID NO: 2771 - DNA, 23 bp, Artificial Sequence
  Description of Artificial Sequence: Synthetic oligonucleotide
ggtgctccccggggacacctggg

SEQ ID NO: 2772 - DNA, 119 bp, Artificial Sequence
  Description of Artificial Sequence: Synthetic polynucleotide
attctaatacgactcactataggggtgctccccggggacacctgttttagagctagaaatagcaagttaaaataaggctagtccgttatcaacttgaaaaagtggcaccgagtcggtgc

SEQ ID NO: 2773 - DNA, 23 bp, Artificial Sequence
  Description of Artificial Sequence: Synthetic oligonucleotide
ccaccgaccagcagacgtctagg

SEQ ID NO: 2774 - DNA, 119 bp, Artificial Sequence
  Description of Artificial Sequence: Synthetic polynucleotide
attctaatacgactcactataggccaccgaccagcagacgtctgttttagagctagaaatagcaagttaaaataaggctagtccgttatcaacttgaaaaagtggcaccgagtcggtgc

SEQ ID NO: 2775 - DNA, 21 bp, Homo sapiens
accagcagacctctaggcagg

SEQ ID NO: 2776 - DNA, 21 bp, Artificial Sequence
  Description of Artificial Sequence: Synthetic oligonucleotide
accagcagacgtctaggcagg

SEQ ID NO: 2777 - DNA, 23 bp, Artificial Sequence
  Description of Artificial Sequence: Synthetic oligonucleotide
cgaccagcagacgtctaggcagg

SEQ ID NO: 2778 - DNA, 119 bp, Artificial Sequence
  Description of Artificial Sequence: Synthetic polynucleotide
attctaatacgactcactataggcgaccagcagacgtctaggcgttttagagctagaaatagcaagttaaaataaggctagtccgttatcaacttgaaaaagtggcaccgagtcggtgc

SEQ ID NO: 2779 - DNA, 23 bp, Artificial Sequence
  Description of Artificial Sequence: Synthetic oligonucleotide
gcagacgtctaggcaggcccagg

SEQ ID NO: 2780 - DNA, 119 bp, Artificial Sequence
  Description of Artificial Sequence: Synthetic polynucleotide
attctaatacgactcactatagggcagacgtctaggcaggcccgttttagagctagaaatagcaagttaaaataaggctagtccgttatcaacttgaaaaagtggcaccgagtcggtgc

SEQ ID NO: 2781 - DNA, 23 bp, Artificial Sequence
  Description of Artificial Sequence: Synthetic oligonucleotide
gggcctgcctagacgtctgctgg

SEQ ID NO: 2782 - DNA, 119 bp, Artificial Sequence
  Description of Artificial Sequence: Synthetic polynucleotide
attctaatacgactcactatagggggcctgcctagacgtctgcgttttagagctagaaatagcaagttaaaataaggctagtccgttatcaacttgaaaaagtggcaccgagtcggtgc

SEQ ID NO: 2783 - DNA, 23 bp, Artificial Sequence
  Description of Artificial Sequence: Synthetic oligonucleotide
cctagacgtctgctggtcggtgg

SEQ ID NO: 2784 - DNA, 119 bp, Artificial Sequence
  Description of Artificial Sequence: Synthetic polynucleotide
attctaatacgactcactataggcctagacgtctgctggtcgggttttagagctagaaatagcaagttaaaataaggctagtccgttatcaacttgaaaaagtggcaccgagtcggtgc

SEQ ID NO: 2785 - DNA, 23 bp, Artificial Sequence
  Description of Artificial Sequence: Synthetic oligonucleotide
ctgcctagacgtctgctggtcgg

SEQ ID NO: 2786 - DNA, 119 bp, Artificial Sequence
  Description of Artificial Sequence: Synthetic polynucleotide
attctaatacgactcactataggctgcctagacgtctgctggtgttttagagctagaaatagcaagttaaaataaggctagtccgttatcaacttgaaaaagtggcaccgagtcggtgc

SEQ ID NO: 2787 - DNA, 23 bp, Artificial Sequence
  Description of Artificial Sequence: Synthetic oligonucleotide
ccccgaagggcctgctgagttgg

SEQ ID NO: 2788 - DNA, 119 bp, Artificial Sequence
  Description of Artificial Sequence: Synthetic polynucleotide
attctaatacgactcactataggccccgaagggcctgctgagtgttttagagctagaaatagcaagttaaaataaggctagtccgttatcaacttgaaaaagtggcaccgagtcggtgc

SEQ ID NO: 2789 - DNA, 21 bp, Homo sapiens
ccccgaaggggctgctgagtt

SEQ ID NO: 2790 - DNA, 21 bp, Artificial Sequence
  Description of Artificial Sequence: Synthetic oligonucleotide
ccccgaagggcctgctgagtt

SEQ ID NO: 2791 - DNA, 23 bp, Artificial Sequence
  Description of Artificial Sequence: Synthetic oligonucleotide
agggcctgctgagttggatctgg

SEQ ID NO: 2792 - DNA, 119 bp, Artificial Sequence
  Description of Artificial Sequence: Synthetic polynucleotide
attctaatacgactcactataggagggcctgctgagttggatcgttttagagctagaaatagcaagttaaaataaggctagtccgttatcaacttgaaaaagtggcaccgagtcggtgc

SEQ ID NO: 2793 - DNA, 23 bp, Artificial Sequence
  Description of Artificial Sequence: Synthetic oligonucleotide
atccaactcagcaggcccttcgg

SEQ ID NO: 2794 - DNA, 119 bp, Artificial Sequence
  Description of Artificial Sequence: Synthetic polynucleotide
attctaatacgactcactataggatccaactcagcaggcccttgttttagagctagaaatagcaagttaaaataaggctagtccgttatcaacttgaaaaagtggcaccgagtcggtgc

SEQ ID NO: 2795 - DNA, 23 bp, Artificial Sequence
  Description of Artificial Sequence: Synthetic oligonucleotide
actcagcaggcccttcggggcgg

SEQ ID NO: 2796 - DNA, 119 bp, Artificial Sequence
  Description of Artificial Sequence: Synthetic polynucleotide
attctaatacgactcactataggactcagcaggcccttcgggggttttagagctagaaatagcaagttaaaataaggctagtccgttatcaacttgaaaaagtggcaccgagtcggtgc

SEQ ID NO: 2797 - DNA, 23 bp, Artificial Sequence
  Description of Artificial Sequence: Synthetic oligonucleotide
tccaactcagcaggcccttcggg

SEQ ID NO: 2798 - DNA, 119 bp, Artificial Sequence
  Description of Artificial Sequence: Synthetic polynucleotide
attctaatacgactcactataggtccaactcagcaggcccttcgttttagagctagaaatagcaagttaaaataaggctagtccgttatcaacttgaaaaagtggcaccgagtcggtgc

SEQ ID NO: 2799 - DNA, 23 bp, Artificial Sequence
  Description of Artificial Sequence: Synthetic oligonucleotide
ccaactcagcaggcccttcgggg

SEQ ID NO: 2800 - DNA, 119 bp, Artificial Sequence
  Description of Artificial Sequence: Synthetic polynucleotide
attctaatacgactcactataggccaactcagcaggcccttcggttttagagctagaaatagcaagttaaaataaggctagtccgttatcaacttgaaaaagtggcaccgagtcggtgc

SEQ ID NO: 2801 - DNA, 23 bp, Artificial Sequence
  Description of Artificial Sequence: Synthetic oligonucleotide
ctgagagcattggaattgcttgg

SEQ ID NO: 2802 - DNA, 119 bp, Artificial Sequence
  Description of Artificial Sequence: Synthetic polynucleotide
attctaatacgactcactataggctgagagcattggaattgctgttttagagctagaaatagcaagttaaaataaggctagtccgttatcaacttgaaaaagtggcaccgagtcggtgc

SEQ ID NO: 2803 - DNA, 21 bp, Homo sapiens
gagcattggacttgcttggaa

SEQ ID NO: 2804 - DNA, 21 bp, Artificial Sequence
  Description of Artificial Sequence: Synthetic oligonucleotide
gagcattggaattgcttggaa

SEQ ID NO: 2805 - DNA, 23 bp, Artificial Sequence
  Description of Artificial Sequence: Synthetic oligonucleotide
ggaattgcttggaagatttttgg

SEQ ID NO: 2806 - DNA, 119 bp, Artificial Sequence
  Description of Artificial Sequence: Synthetic polynucleotide
attctaatacgactcactataggggaattgcttggaagattttgttttagagctagaaatagcaagttaaaataaggctagtccgttatcaacttgaaaaagtggcaccgagtcggtgc

SEQ ID NO: 2807 - DNA, 23 bp, Artificial Sequence
  Description of Artificial Sequence: Synthetic oligonucleotide
gcaattccaatgctctcagccgg

SEQ ID NO: 2808 - DNA, 119 bp, Artificial Sequence
  Description of Artificial Sequence: Synthetic polynucleotide
attctaatacgactcactatagggcaattccaatgctctcagcgttttagagctagaaatagcaagttaaaataaggctagtccgttatcaacttgaaaaagtggcaccgagtcggtgc

SEQ ID NO: 2809 - DNA, 23 bp, Artificial Sequence
  Description of Artificial Sequence: Synthetic oligonucleotide
gtccaccatggagaactggtagg

SEQ ID NO: 2810 - DNA, 119 bp, Artificial Sequence
  Description of Artificial Sequence: Synthetic polynucleotide
attctaatacgactcactatagggtccaccatggagaactggtgttttagagctagaaatagcaagttaaaataaggctagtccgttatcaacttgaaaaagtggcaccgagtcggtgc

SEQ ID NO: 2811 - DNA, 21 bp, Homo sapiens
gcgctcgccgcccaccatgga

SEQ ID NO: 2812 - DNA, 21 bp, Artificial Sequence
  Description of Artificial Sequence: Synthetic oligonucleotide
gcgctcgccgtccaccatgga

SEQ ID NO: 2813 - DNA, 23 bp, Artificial Sequence
  Description of Artificial Sequence: Synthetic oligonucleotide
cgagcgctcgccgtccaccatgg

SEQ ID NO: 2814 - DNA, 119 bp, Artificial Sequence
  Description of Artificial Sequence: Synthetic polynucleotide
attctaatacgactcactataggcgagcgctcgccgtccaccagttttagagctagaaatagcaagttaaaataaggctagtccgttatcaacttgaaaaagtggcaccgagtcggtgc

SEQ ID NO: 2815 - DNA, 23 bp, Artificial Sequence
  Description of Artificial Sequence: Synthetic oligonucleotide
cgccgtccaccatggagaactgg

SEQ ID NO: 2816 - DNA, 119 bp, Artificial Sequence
  Description of Artificial Sequence: Synthetic polynucleotide
attctaatacgactcactataggcgccgtccaccatggagaacgttttagagctagaaatagcaagttaaaataaggctagtccgttatcaacttgaaaaagtggcaccgagtcggtgc

SEQ ID NO: 2817 - DNA, 23 bp, Artificial Sequence
  Description of Artificial Sequence: Synthetic oligonucleotide
taccagttctccatggtggacgg

SEQ ID NO: 2818 - DNA, 119 bp, Artificial Sequence
  Description of Artificial Sequence: Synthetic polynucleotide
attctaatacgactcactataggtaccagttctccatggtggagttttagagctagaaatagcaagttaaaataaggctagtccgttatcaacttgaaaaagtggcaccgagtcggtgc

SEQ ID NO: 2819 - DNA, 23 bp, Artificial Sequence
  Description of Artificial Sequence: Synthetic oligonucleotide
gtatttttgttggtaacactagg

SEQ ID NO: 2820 - DNA, 119 bp, Artificial Sequence
  Description of Artificial Sequence: Synthetic polynucleotide
attctaatacgactcactatagggtatttttgttggtaacactgttttagagctagaaatagcaagttaaaataaggctagtccgttatcaacttgaaaaagtggcaccgagtcggtgc

SEQ ID NO: 2821 - DNA, 23 bp, Artificial Sequence
  Description of Artificial Sequence: Synthetic oligonucleotide
tttcttgttggtatttttgttgg

SEQ ID NO: 2822 - DNA, 119 bp, Artificial Sequence
  Description of Artificial Sequence: Synthetic polynucleotide
attctaatacgactcactataggtttcttgttggtatttttgtgttttagagctagaaatagcaagttaaaataaggctagtccgttatcaacttgaaaaagtggcaccgagtcggtgc

SEQ ID NO: 2823 - DNA, 23 bp, Artificial Sequence
  Description of Artificial Sequence: Synthetic oligonucleotide
tattgcacaccttacatggaagg

SEQ ID NO: 2824 - DNA, 119 bp, Artificial Sequence
  Description of Artificial Sequence: Synthetic polynucleotide
attctaatacgactcactataggtattgcacaccttacatggagttttagagctagaaatagcaagttaaaataaggctagtccgttatcaacttgaaaaagtggcaccgagtcggtgc

SEQ ID NO: 2825 - DNA, 21 bp, Homo sapiens
gcacaccttatatggaagggt

SEQ ID NO: 2826 - DNA, 21 bp, Artificial Sequence
  Description of Artificial Sequence: Synthetic oligonucleotide
gcacaccttacatggaagggt

SEQ ID NO: 2827 - DNA, 23 bp, Artificial Sequence
  Description of Artificial Sequence: Synthetic oligonucleotide
acaccttacatggaagggtaagg

SEQ ID NO: 2828 - DNA, 119 bp, Artificial Sequence
  Description of Artificial Sequence: Synthetic polynucleotide
attctaatacgactcactataggacaccttacatggaagggtagttttagagctagaaatagcaagttaaaataaggctagtccgttatcaacttgaaaaagtggcaccgagtcggtgc

SEQ ID NO: 2829 - DNA, 23 bp, Artificial Sequence
  Description of Artificial Sequence: Synthetic oligonucleotide
tcgctattgcacaccttacatgg

SEQ ID NO: 2830 - DNA, 119 bp, Artificial Sequence
  Description of Artificial Sequence: Synthetic polynucleotide
attctaatacgactcactataggtcgctattgcacaccttacagttttagagctagaaatagcaagttaaaataaggctagtccgttatcaacttgaaaaagtggcaccgagtcggtgc

SEQ ID NO: 2831 - DNA, 23 bp, Artificial Sequence
  Description of Artificial Sequence: Synthetic oligonucleotide
attgcacaccttacatggaaggg

SEQ ID NO: 2832 - DNA, 119 bp, Artificial Sequence
  Description of Artificial Sequence: Synthetic polynucleotide
attctaatacgactcactataggattgcacaccttacatggaagttttagagctagaaatagcaagttaaaataaggctagtccgttatcaacttgaaaaagtggcaccgagtcggtgc

SEQ ID NO: 2833 - DNA, 23 bp, Artificial Sequence
  Description of Artificial Sequence: Synthetic oligonucleotide
cggccttacccttccatgtaagg

SEQ ID NO: 2834 - DNA, 119 bp, Artificial Sequence
  Description of Artificial Sequence: Synthetic polynucleotide
attctaatacgactcactataggcggccttacccttccatgtagttttagagctagaaatagcaagttaaaataaggctagtccgttatcaacttgaaaaagtggcaccgagtcggtgc

SEQ ID NO: 2835 - DNA, 23 bp, Artificial Sequence
  Description of Artificial Sequence: Synthetic oligonucleotide
gtaaggtgtgcaatagcgagtgg

SEQ ID NO: 2836 - DNA, 119 bp, Artificial Sequence
  Description of Artificial Sequence: Synthetic polynucleotide
attctaatacgactcactatagggtaaggtgtgcaatagcgaggttttagagctagaaatagcaagttaaaataaggctagtccgttatcaacttgaaaaagtggcaccgagtcggtgc

SEQ ID NO: 2837 - DNA, 23 bp, Artificial Sequence
  Description of Artificial Sequence: Synthetic oligonucleotide
tttttctttatggggctttcagg

SEQ ID NO: 2838 - DNA, 119 bp, Artificial Sequence
  Description of Artificial Sequence: Synthetic polynucleotide
attctaatacgactcactataggtttttctttatggggctttcgttttagagctagaaatagcaagttaaaataaggctagtccgttatcaacttgaaaaagtggcaccgagtcggtgc

SEQ ID NO: 2839 - DNA, 23 bp, Artificial Sequence
  Description of Artificial Sequence: Synthetic oligonucleotide
aggtgttttatttttctttatgg

SEQ ID NO: 2840 - DNA, 119 bp, Artificial Sequence
  Description of Artificial Sequence: Synthetic polynucleotide
attctaatacgactcactataggaggtgttttatttttctttagttttagagctagaaatagcaagttaaaataaggctagtccgttatcaacttgaaaaagtggcaccgagtcggtgc

SEQ ID NO: 2841 - DNA, 23 bp, Artificial Sequence
  Description of Artificial Sequence: Synthetic oligonucleotide
ggtgttttatttttctttatggg

SEQ ID NO: 2842 - DNA, 119 bp, Artificial Sequence
  Description of Artificial Sequence: Synthetic polynucleotide
attctaatacgactcactataggggtgttttatttttctttatgttttagagctagaaatagcaagttaaaataaggctagtccgttatcaacttgaaaaagtggcaccgagtcggtgc

SEQ ID NO: 2843 - DNA, 23 bp, Artificial Sequence
  Description of Artificial Sequence: Synthetic oligonucleotide
gtgttttatttttctttatgggg

SEQ ID NO: 2844 - DNA, 119 bp, Artificial Sequence
  Description of Artificial Sequence: Synthetic polynucleotide
attctaatacgactcactatagggtgttttatttttctttatggttttagagctagaaatagcaagttaaaataaggctagtccgttatcaacttgaaaaagtggcaccgagtcggtgc

SEQ ID NO: 2845 - DNA, 23 bp, Artificial Sequence
  Description of Artificial Sequence: Synthetic oligonucleotide
gctcggcctgtacctccagtcgg

SEQ ID NO: 2846 - DNA, 119 bp, Artificial Sequence
  Description of Artificial Sequence: Synthetic polynucleotide
attctaatacgactcactatagggctcggcctgtacctccagtgttttagagctagaaatagcaagttaaaataaggctagtccgttatcaacttgaaaaagtggcaccgagtcggtgc

SEQ ID NO: 2847 - DNA, 21 bp, Homo sapiens
gctcggcctgaacctccagtc

SEQ ID NO: 2848 - DNA, 21 bp, Artificial Sequence
  Description of Artificial Sequence: Synthetic oligonucleotide
gctcggcctgtacctccagtc

SEQ ID NO: 2849 - DNA, 23 bp, Artificial Sequence
  Description of Artificial Sequence: Synthetic oligonucleotide
tgtctgccgactggaggtacagg

SEQ ID NO: 2850 - DNA, 119 bp, Artificial Sequence
  Description of Artificial Sequence: Synthetic polynucleotide
attctaatacgactcactataggtgtctgccgactggaggtacgttttagagctagaaatagcaagttaaaataaggctagtccgttatcaacttgaaaaagtggcaccgagtcggtgc

SEQ ID NO: 2851 - DNA, 23 bp, Artificial Sequence
  Description of Artificial Sequence: Synthetic oligonucleotide
acaggccgagccccccagcccgg

SEQ ID NO: 2852 - DNA, 119 bp, Artificial Sequence
  Description of Artificial Sequence: Synthetic polynucleotide
attctaatacgactcactataggacaggccgagccccccagccgttttagagctagaaatagcaagttaaaataaggctagtccgttatcaacttgaaaaagtggcaccgagtcggtgc

SEQ ID NO: 2853 - DNA, 23 bp, Artificial Sequence
  Description of Artificial Sequence: Synthetic oligonucleotide
cacgctggagtagatcgaagagg

SEQ ID NO: 2854 - DNA, 119 bp, Artificial Sequence
  Description of Artificial Sequence: Synthetic polynucleotide
attctaatacgactcactataggcacgctggagtagatcgaaggttttagagctagaaatagcaagttaaaataaggctagtccgttatcaacttgaaaaagtggcaccgagtcggtgc

SEQ ID NO: 2855 - DNA, 21 bp, Homo sapiens
cacgctggaggagatcgaaga

SEQ ID NO: 2856 - DNA, 21 bp, Artificial Sequence
  Description of Artificial Sequence: Synthetic oligonucleotide
cacgctggagtagatcgaaga

SEQ ID NO: 2857 - DNA, 23 bp, Artificial Sequence
  Description of Artificial Sequence: Synthetic oligonucleotide
gctggagtagatcgaagaggagg

SEQ ID NO: 2858 - DNA, 119 bp, Artificial Sequence
  Description of Artificial Sequence: Synthetic polynucleotide
attctaatacgactcactatagggctggagtagatcgaagagggttttagagctagaaatagcaagttaaaataaggctagtccgttatcaacttgaaaaagtggcaccgagtcggtgc

SEQ ID NO: 2859 - DNA, 23 bp, Artificial Sequence
  Description of Artificial Sequence: Synthetic oligonucleotide
agtagatcgaagaggaggtccgg

SEQ ID NO: 2860 - DNA, 119 bp, Artificial Sequence
  Description of Artificial Sequence: Synthetic polynucleotide
attctaatacgactcactataggagtagatcgaagaggaggtcgttttagagctagaaatagcaagttaaaataaggctagtccgttatcaacttgaaaaagtggcaccgagtcggtgc

SEQ ID NO: 2861 - DNA, 23 bp, Artificial Sequence
  Description of Artificial Sequence: Synthetic oligonucleotide
tgcagatcaaaggtttggagagg

SEQ ID NO: 2862 - DNA, 119 bp, Artificial Sequence
  Description of Artificial Sequence: Synthetic polynucleotide
attctaatacgactcactataggtgcagatcaaaggtttggaggttttagagctagaaatagcaagttaaaataaggctagtccgttatcaacttgaaaaagtggcaccgagtcggtgc

SEQ ID NO: 2863 - DNA, 23 bp, Artificial Sequence
  Description of Artificial Sequence: Synthetic oligonucleotide
gatcaaaggtttggagaggctgg

SEQ ID NO: 2864 - DNA, 119 bp, Artificial Sequence
  Description of Artificial Sequence: Synthetic polynucleotide
attctaatacgactcactatagggatcaaaggtttggagaggcgttttagagctagaaatagcaagttaaaataaggctagtccgttatcaacttgaaaaagtggcaccgagtcggtgc

SEQ ID NO: 2865 - DNA, 23 bp, Artificial Sequence
  Description of Artificial Sequence: Synthetic oligonucleotide
ctatgctgtcactgagagagtgg

SEQ ID NO: 2866 - DNA, 119 bp, Artificial Sequence
  Description of Artificial Sequence: Synthetic polynucleotide
attctaatacgactcactataggctatgctgtcactgagagaggttttagagctagaaatagcaagttaaaataaggctagtccgttatcaacttgaaaaagtggcaccgagtcggtgc

SEQ ID NO: 2867 - DNA, 23 bp, Homo sapiens
gcagtcctactatgccgtggccc

SEQ ID NO: 2868 - protein, 8 aa, Homo sapiens
QSYYAVAH

SEQ ID NO: 2869 - DNA, 43 bp, Homo sapiens
cacgtggcctgcagtcctactatgccgtggcccatgctgtcac

SEQ ID NO: 2870 - DNA, 20 bp, Artificial Sequence
  Description of Artificial Sequence: Synthetic oligonucleotide
cacgtggcctatgctgtcac

SEQ ID NO: 2871 - DNA, 23 bp, Artificial Sequence
  Description of Artificial Sequence: Synthetic oligonucleotide
cactctctcagtgacagcatagg

SEQ ID NO: 2872 - DNA, 119 bp, Artificial Sequence
  Description of Artificial Sequence: Synthetic polynucleotide
attctaatacgactcactataggcactctctcagtgacagcatgttttagagctagaaatagcaagttaaaataaggctagtccgttatcaacttgaaaaagtggcaccgagtcggtgc

SEQ ID NO: 2873 - DNA, 23 bp, Artificial Sequence
  Description of Artificial Sequence: Synthetic oligonucleotide
gacagcataggccacgtgcaagg

SEQ ID NO: 2874 - DNA, 119 bp, Artificial Sequence
  Description of Artificial Sequence: Synthetic polynucleotide
attctaatacgactcactatagggacagcataggccacgtgcagttttagagctagaaatagcaagttaaaataaggctagtccgttatcaacttgaaaaagtggcaccgagtcggtgc

SEQ ID NO: 2875 - DNA, 23 bp, Artificial Sequence
  Description of Artificial Sequence: Synthetic oligonucleotide
ataggccacgtgcaagggcctgg

SEQ ID NO: 2876 - DNA, 119 bp, Artificial Sequence
  Description of Artificial Sequence: Synthetic polynucleotide
attctaatacgactcactataggataggccacgtgcaagggccgttttagagctagaaatagcaagttaaaataaggctagtccgttatcaacttgaaaaagtggcaccgagtcggtgc

SEQ ID NO: 2877 - DNA, 23 bp, Artificial Sequence
  Description of Artificial Sequence: Synthetic oligonucleotide
acagcataggccacgtgcaaggg

SEQ ID NO: 2878 - DNA, 119 bp, Artificial Sequence
  Description of Artificial Sequence: Synthetic polynucleotide
attctaatacgactcactataggacagcataggccacgtgcaagttttagagctagaaatagcaagttaaaataaggctagtccgttatcaacttgaaaaagtggcaccgagtcggtgc

SEQ ID NO: 2879 - DNA, 23 bp, Artificial Sequence
  Description of Artificial Sequence: Synthetic oligonucleotide
taggccacgtgcaagggcctggg

SEQ ID NO: 2880 - DNA, 119 bp, Artificial Sequence
  Description of Artificial Sequence: Synthetic polynucleotide
attctaatacgactcactataggtaggccacgtgcaagggcctgttttagagctagaaatagcaagttaaaataaggctagtccgttatcaacttgaaaaagtggcaccgagtcggtgc

SEQ ID NO: 2881 - DNA, 23 bp, Artificial Sequence
  Description of Artificial Sequence: Synthetic oligonucleotide
ttcctgctcagcacccgggctgg

SEQ ID NO: 2882 - DNA, 119 bp, Artificial Sequence
  Description of Artificial Sequence: Synthetic polynucleotide
attctaatacgactcactataggttcctgctcagcacccgggcgttttagagctagaaatagcaagttaaaataaggctagtccgttatcaacttgaaaaagtggcaccgagtcggtgc

SEQ ID NO: 2883 - DNA, 21 bp, Homo sapiens
cacccgggctggggggctcgg

SEQ ID NO: 2884 - DNA, 20 bp, Artificial Sequence
  Description of Artificial Sequence: Synthetic oligonucleotide
cacccgggctgggggctcgg

SEQ ID NO: 2885 - DNA, 23 bp, Artificial Sequence
  Description of Artificial Sequence: Synthetic oligonucleotide
cagcacccgggctgggggctcgg

SEQ ID NO: 2886 - DNA, 119 bp, Artificial Sequence
  Description of Artificial Sequence: Synthetic polynucleotide
attctaatacgactcactataggcagcacccgggctgggggctgttttagagctagaaatagcaagttaaaataaggctagtccgttatcaacttgaaaaagtggcaccgagtcggtgc

SEQ ID NO: 2887 - DNA, 23 bp, Artificial Sequence
  Description of Artificial Sequence: Synthetic oligonucleotide
tcctgctcagcacccgggctggg

SEQ ID NO: 2888 - DNA, 119 bp, Artificial Sequence
  Description of Artificial Sequence: Synthetic polynucleotide
attctaatacgactcactataggtcctgctcagcacccgggctgttttagagctagaaatagcaagttaaaataaggctagtccgttatcaacttgaaaaagtggcaccgagtcggtgc

SEQ ID NO: 2889 - DNA, 23 bp, Artificial Sequence
  Description of Artificial Sequence: Synthetic oligonucleotide
cctgctcagcacccgggctgggg

SEQ ID NO: 2890 - DNA, 119 bp, Artificial Sequence
  Description of Artificial Sequence: Synthetic polynucleotide
attctaatacgactcactataggcctgctcagcacccgggctggttttagagctagaaatagcaagttaaaataaggctagtccgttatcaacttgaaaaagtggcaccgagtcggtgc

SEQ ID NO: 2891 - DNA, 23 bp, Artificial Sequence
  Description of Artificial Sequence: Synthetic oligonucleotide
ctgctcagcacccgggctggggg

SEQ ID NO: 2892 - DNA, 119 bp, Artificial Sequence
  Description of Artificial Sequence: Synthetic polynucleotide
attctaatacgactcactataggctgctcagcacccgggctgggttttagagctagaaatagcaagttaaaataaggctagtccgttatcaacttgaaaaagtggcaccgagtcggtgc

SEQ ID NO: 2893 - DNA, 23 bp, Artificial Sequence
  Description of Artificial Sequence: Synthetic oligonucleotide
ccccagcccgggtgctgagcagg

SEQ ID NO: 2894 - DNA, 119 bp, Artificial Sequence
  Description of Artificial Sequence: Synthetic polynucleotide
attctaatacgactcactataggccccagcccgggtgctgagcgttttagagctagaaatagcaagttaaaataaggctagtccgttatcaacttgaaaaagtggcaccgagtcggtgc

SEQ ID NO: 2895 - DNA, 23 bp, Artificial Sequence
  Description of Artificial Sequence: Synthetic oligonucleotide
ttcaggccgagcccccagcccgg

SEQ ID NO: 2896 - DNA, 119 bp, Artificial Sequence
  Description of Artificial Sequence: Synthetic polynucleotide
attctaatacgactcactataggttcaggccgagcccccagccgttttagagctagaaatagcaagttaaaataaggctagtccgttatcaacttgaaaaagtggcaccgagtcggtgc

SEQ ID NO: 2897 - DNA, 23 bp, Artificial Sequence
  Description of Artificial Sequence: Synthetic oligonucleotide
tcaggccgagcccccagcccggg

SEQ ID NO: 2898 - DNA, 119 bp, Artificial Sequence
  Description of Artificial Sequence: Synthetic polynucleotide
attctaatacgactcactataggtcaggccgagcccccagcccgttttagagctagaaatagcaagttaaaataaggctagtccgttatcaacttgaaaaagtggcaccgagtcggtgc

SEQ ID NO: 2899 - DNA, 23 bp, Artificial Sequence
  Description of Artificial Sequence: Synthetic oligonucleotide
tgtcaggccaatgtgaccatagg

SEQ ID NO: 2900 - DNA, 119 bp, Artificial Sequence
  Description of Artificial Sequence: Synthetic polynucleotide
attctaatacgactcactataggtgtcaggccaatgtgaccatgttttagagctagaaatagcaagttaaaataaggctagtccgttatcaacttgaaaaagtggcaccgagtcggtgc

SEQ ID NO: 2901 - DNA, 21 bp, Homo sapiens
atgtgaccatcgggctgccca

SEQ ID NO: 2902 - DNA, 21 bp, Artificial Sequence
  Description of Artificial Sequence: Synthetic oligonucleotide
atgtgaccatagggctgccca

SEQ ID NO: 2903 - DNA, 23 bp, Artificial Sequence
  Description of Artificial Sequence: Synthetic oligonucleotide
gtcaggccaatgtgaccataggg

SEQ ID NO: 2904 - DNA, 119 bp, Artificial Sequence
  Description of Artificial Sequence: Synthetic polynucleotide
attctaatacgactcactatagggtcaggccaatgtgaccatagttttagagctagaaatagcaagttaaaataaggctagtccgttatcaacttgaaaaagtggcaccgagtcggtgc

SEQ ID NO: 2905 - DNA, 23 bp, Artificial Sequence
  Description of Artificial Sequence: Synthetic oligonucleotide
ctgcttggtgggcagccctatgg

SEQ ID NO: 2906 - DNA, 119 bp, Artificial Sequence
  Description of Artificial Sequence: Synthetic polynucleotide
attctaatacgactcactataggctgcttggtgggcagccctagttttagagctagaaatagcaagttaaaataaggctagtccgttatcaacttgaaaaagtggcaccgagtcggtgc

SEQ ID NO: 2907 - DNA, 23 bp, Artificial Sequence
  Description of Artificial Sequence: Synthetic oligonucleotide
gggcagccctatggtcacattgg

SEQ ID NO: 2908 - DNA, 119 bp, Artificial Sequence
  Description of Artificial Sequence: Synthetic polynucleotide
attctaatacgactcactatagggggcagccctatggtcacatgttttagagctagaaatagcaagttaaaataaggctagtccgttatcaacttgaaaaagtggcaccgagtcggtgc

SEQ ID NO: 2909 - DNA, 23 bp, Artificial Sequence
  Description of Artificial Sequence: Synthetic oligonucleotide
gcccagtgcaccggccccagtgg

SEQ ID NO: 2910 - DNA, 119 bp, Artificial Sequence
  Description of Artificial Sequence: Synthetic polynucleotide
attctaatacgactcactatagggcccagtgcaccggccccaggttttagagctagaaatagcaagttaaaataaggctagtccgttatcaacttgaaaaagtggcaccgagtcggtgc

SEQ ID NO: 2911 - DNA, 23 bp, Artificial Sequence
  Description of Artificial Sequence: Synthetic oligonucleotide
gtgcaccggccccagtggcatgg

SEQ ID NO: 2912 - DNA, 119 bp, Artificial Sequence
  Description of Artificial Sequence: Synthetic polynucleotide
attctaatacgactcactatagggtgcaccggccccagtggcagttttagagctagaaatagcaagttaaaataaggctagtccgttatcaacttgaaaaagtggcaccgagtcggtgc

SEQ ID NO: 2913 - DNA, 23 bp, Artificial Sequence
  Description of Artificial Sequence: Synthetic oligonucleotide
gccccagtggcatgggctcatgg

SEQ ID NO: 2914 - DNA, 119 bp, Artificial Sequence
  Description of Artificial Sequence: Synthetic polynucleotide
attctaatacgactcactatagggccccagtggcatgggctcagttttagagctagaaatagcaagttaaaataaggctagtccgttatcaacttgaaaaagtggcaccgagtcggtgc

SEQ ID NO: 2915 - DNA, 23 bp, Artificial Sequence
  Description of Artificial Sequence: Synthetic oligonucleotide
tgcaccggccccagtggcatggg

SEQ ID NO: 2916 - DNA, 119 bp, Artificial Sequence
  Description of Artificial Sequence: Synthetic polynucleotide
attctaatacgactcactataggtgcaccggccccagtggcatgttttagagctagaaatagcaagttaaaataaggctagtccgttatcaacttgaaaaagtggcaccgagtcggtgc

SEQ ID NO: 2917 - DNA, 23 bp, Artificial Sequence
  Description of Artificial Sequence: Synthetic oligonucleotide
cggccatgagcccatgccactgg

SEQ ID NO: 2918 - DNA, 119 bp, Artificial Sequence
  Description of Artificial Sequence: Synthetic polynucleotide
attctaatacgactcactataggcggccatgagcccatgccacgttttagagctagaaatagcaagttaaaataaggctagtccgttatcaacttgaaaaagtggcaccgagtcggtgc

SEQ ID NO: 2919 - DNA, 23 bp, Artificial Sequence
  Description of Artificial Sequence: Synthetic oligonucleotide
tgccactggggccggtgcactgg

SEQ ID NO: 2920 - DNA, 119 bp, Artificial Sequence
  Description of Artificial Sequence: Synthetic polynucleotide
attctaatacgactcactataggtgccactggggccggtgcacgttttagagctagaaatagcaagttaaaataaggctagtccgttatcaacttgaaaaagtggcaccgagtcggtgc

SEQ ID NO: 2921 - DNA, 23 bp, Artificial Sequence
  Description of Artificial Sequence: Synthetic oligonucleotide
tgagcccatgccactggggccgg

SEQ ID NO: 2922 - DNA, 119 bp, Artificial Sequence
  Description of Artificial Sequence: Synthetic polynucleotide
attctaatacgactcactataggtgagcccatgccactggggcgttttagagctagaaatagcaagttaaaataaggctagtccgttatcaacttgaaaaagtggcaccgagtcggtgc

SEQ ID NO: 2923 - DNA, 23 bp, Artificial Sequence
  Description of Artificial Sequence: Synthetic oligonucleotide
ggccatgagcccatgccactggg

SEQ ID NO: 2924 - DNA, 119 bp, Artificial Sequence
  Description of Artificial Sequence: Synthetic polynucleotide
attctaatacgactcactataggggccatgagcccatgccactgttttagagctagaaatagcaagttaaaataaggctagtccgttatcaacttgaaaaagtggcaccgagtcggtgc

SEQ ID NO: 2925 - DNA, 23 bp, Artificial Sequence
  Description of Artificial Sequence: Synthetic oligonucleotide
gccatgagcccatgccactgggg

SEQ ID NO: 2926 - DNA, 119 bp, Artificial Sequence
  Description of Artificial Sequence: Synthetic polynucleotide
attctaatacgactcactatagggccatgagcccatgccactggttttagagctagaaatagcaagttaaaataaggctagtccgttatcaacttgaaaaagtggcaccgagtcggtgc

SEQ ID NO: 2927 - DNA, 23 bp, Artificial Sequence
  Description of Artificial Sequence: Synthetic oligonucleotide
gccactggggccggtgcactggg

SEQ ID NO: 2928 - DNA, 119 bp, Artificial Sequence
  Description of Artificial Sequence: Synthetic polynucleotide
attctaatacgactcactatagggccactggggccggtgcactgttttagagctagaaatagcaagttaaaataaggctagtccgttatcaacttgaaaaagtggcaccgagtcggtgc

SEQ ID NO: 2929 - DNA, 23 bp, Artificial Sequence
  Description of Artificial Sequence: Synthetic oligonucleotide
agacccacagcccccagcattgg

SEQ ID NO: 2930 - DNA, 119 bp, Artificial Sequence
  Description of Artificial Sequence: Synthetic polynucleotide
attctaatacgactcactataggagacccacagcccccagcatgttttagagctagaaatagcaagttaaaataaggctagtccgttatcaacttgaaaaagtggcaccgagtcggtgc

SEQ ID NO: 2931 - DNA, 21 bp, Homo sapiens
gcccccagcactgggaacaac

SEQ ID NO: 2932 - DNA, 21 bp, Artificial Sequence
  Description of Artificial Sequence: Synthetic oligonucleotide
gcccccagcattgggaacaac

SEQ ID NO: 2933 - DNA, 23 bp, Artificial Sequence
  Description of Artificial Sequence: Synthetic oligonucleotide
gacccacagcccccagcattggg

SEQ ID NO: 2934 - DNA, 119 bp, Artificial Sequence
  Description of Artificial Sequence: Synthetic polynucleotide
attctaatacgactcactatagggacccacagcccccagcattgttttagagctagaaatagcaagttaaaataaggctagtccgttatcaacttgaaaaagtggcaccgagtcggtgc

SEQ ID NO: 2935 - DNA, 23 bp, Artificial Sequence
  Description of Artificial Sequence: Synthetic oligonucleotide
agacgggttgttcccaatgctgg

SEQ ID NO: 2936 - DNA, 119 bp, Artificial Sequence
  Description of Artificial Sequence: Synthetic polynucleotide
attctaatacgactcactataggagacgggttgttcccaatgcgttttagagctagaaatagcaagttaaaataaggctagtccgttatcaacttgaaaaagtggcaccgagtcggtgc

SEQ ID NO: 2937 - DNA, 23 bp, Artificial Sequence
  Description of Artificial Sequence: Synthetic oligonucleotide
gttcccaatgctgggggctgtgg

SEQ ID NO: 2938 - DNA, 119 bp, Artificial Sequence
  Description of Artificial Sequence: Synthetic polynucleotide
attctaatacgactcactatagggttcccaatgctgggggctggttttagagctagaaatagcaagttaaaataaggctagtccgttatcaacttgaaaaagtggcaccgagtcggtgc

SEQ ID NO: 2939 - DNA, 23 bp, Artificial Sequence
  Description of Artificial Sequence: Synthetic oligonucleotide
gacgggttgttcccaatgctggg

SEQ ID NO: 2940 - DNA, 119 bp, Artificial Sequence
  Description of Artificial Sequence: Synthetic polynucleotide
attctaatacgactcactatagggacgggttgttcccaatgctgttttagagctagaaatagcaagttaaaataaggctagtccgttatcaacttgaaaaagtggcaccgagtcggtgc

SEQ ID NO: 2941 - DNA, 23 bp, Artificial Sequence
  Description of Artificial Sequence: Synthetic oligonucleotide
acgggttgttcccaatgctgggg

SEQ ID NO: 2942 - DNA, 119 bp, Artificial Sequence
  Description of Artificial Sequence: Synthetic polynucleotide
attctaatacgactcactataggacgggttgttcccaatgctggttttagagctagaaatagcaagttaaaataaggctagtccgttatcaacttgaaaaagtggcaccgagtcggtgc

SEQ ID NO: 2943 - DNA, 23 bp, Artificial Sequence
  Description of Artificial Sequence: Synthetic oligonucleotide
cgggttgttcccaatgctggggg

SEQ ID NO: 2944 - DNA, 119 bp, Artificial Sequence
  Description of Artificial Sequence: Synthetic polynucleotide
attctaatacgactcactataggcgggttgttcccaatgctgggttttagagctagaaatagcaagttaaaataaggctagtccgttatcaacttgaaaaagtggcaccgagtcggtgc

SEQ ID NO: 2945 - DNA, 23 bp, Artificial Sequence
  Description of Artificial Sequence: Synthetic oligonucleotide
ttcccaatgctgggggctgtggg

SEQ ID NO: 2946 - DNA, 119 bp, Artificial Sequence
  Description of Artificial Sequence: Synthetic polynucleotide
attctaatacgactcactataggttcccaatgctgggggctgtgttttagagctagaaatagcaagttaaaataaggctagtccgttatcaacttgaaaaagtggcaccgagtcggtgc

SEQ ID NO: 2947 - DNA, 23 bp, Artificial Sequence
  Description of Artificial Sequence: Synthetic oligonucleotide
gtcctcctccggcatgagcgagg

SEQ ID NO: 2948 - DNA, 119 bp, Artificial Sequence
  Description of Artificial Sequence: Synthetic polynucleotide
attctaatacgactcactatagggtcctcctccggcatgagcggttttagagctagaaatagcaagttaaaataaggctagtccgttatcaacttgaaaaagtggcaccgagtcggtgc

SEQ ID NO: 2949 - DNA, 21 bp, Homo sapiens
actcgccacactcctcctccg

SEQ ID NO: 2950 - DNA, 21 bp, Artificial Sequence
  Description of Artificial Sequence: Synthetic oligonucleotide
actcgccacagtcctcctccg

SEQ ID NO: 2951 - DNA, 23 bp, Artificial Sequence
  Description of Artificial Sequence: Synthetic oligonucleotide
gactcgccacagtcctcctccgg

SEQ ID NO: 2952 - DNA, 119 bp, Artificial Sequence
  Description of Artificial Sequence: Synthetic polynucleotide
attctaatacgactcactatagggactcgccacagtcctcctcgttttagagctagaaatagcaagttaaaataaggctagtccgttatcaacttgaaaaagtggcaccgagtcggtgc

SEQ ID NO: 2953 - DNA, 23 bp, Artificial Sequence
  Description of Artificial Sequence: Synthetic oligonucleotide
ctcatgccggaggaggactgtgg

SEQ ID NO: 2954 - DNA, 119 bp, Artificial Sequence
  Description of Artificial Sequence: Synthetic polynucleotide
attctaatacgactcactataggctcatgccggaggaggactggttttagagctagaaatagcaagttaaaataaggctagtccgttatcaacttgaaaaagtggcaccgagtcggtgc

SEQ ID NO: 2955 - DNA, 23 bp, Artificial Sequence
  Description of Artificial Sequence: Synthetic oligonucleotide
ggaggaggactgtggcgagtcgg

SEQ ID NO: 2956 - DNA, 119 bp, Artificial Sequence
  Description of Artificial Sequence: Synthetic polynucleotide
attctaatacgactcactataggggaggaggactgtggcgagtgttttagagctagaaatagcaagttaaaataaggctagtccgttatcaacttgaaaaagtggcaccgagtcggtgc

SEQ ID NO: 2957 - DNA, 23 bp, Artificial Sequence
  Description of Artificial Sequence: Synthetic oligonucleotide
gcacaatgcctttgctgagccgg

SEQ ID NO: 2958 - DNA, 119 bp, Artificial Sequence
  Description of Artificial Sequence: Synthetic polynucleotide
attctaatacgactcactatagggcacaatgcctttgctgagcgttttagagctagaaatagcaagttaaaataaggctagtccgttatcaacttgaaaaagtggcaccgagtcggtgc

SEQ ID NO: 2959 - DNA, 21 bp, Homo sapiens
tgtgctgtgggacaatgcctt

SEQ ID NO: 2960 - DNA, 21 bp, Artificial Sequence
  Description of Artificial Sequence: Synthetic oligonucleotide
tgtgctgtggcacaatgcctt

SEQ ID NO: 2961 - DNA, 23 bp, Artificial Sequence
  Description of Artificial Sequence: Synthetic oligonucleotide
gtgccacagcacagtagccgtgg

SEQ ID NO: 2962 - DNA, 119 bp, Artificial Sequence
  Description of Artificial Sequence: Synthetic polynucleotide
attctaatacgactcactatagggtgccacagcacagtagccggttttagagctagaaatagcaagttaaaataaggctagtccgttatcaacttgaaaaagtggcaccgagtcggtgc

SEQ ID NO: 2963 - DNA, 23 bp, Artificial Sequence
  Description of Artificial Sequence: Synthetic oligonucleotide
tctactagccgcgccgcaagcgg

SEQ ID NO: 2964 - DNA, 119 bp, Artificial Sequence
  Description of Artificial Sequence: Synthetic polynucleotide
attctaatacgactcactataggtctactagccgcgccgcaaggttttagagctagaaatagcaagttaaaataaggctagtccgttatcaacttgaaaaagtggcaccgagtcggtgc

SEQ ID NO: 2965 - DNA, 21 bp, Homo sapiens
ggtcatctaccagccgcgccg

SEQ ID NO: 2966 - DNA, 21 bp, Artificial Sequence
  Description of Artificial Sequence: Synthetic oligonucleotide
ggtcatctactagccgcgccg

SEQ ID NO: 2967 - DNA, 23 bp, Artificial Sequence
  Description of Artificial Sequence: Synthetic oligonucleotide
ctactagccgcgccgcaagcggg

SEQ ID NO: 2968 - DNA, 119 bp, Artificial Sequence
  Description of Artificial Sequence: Synthetic polynucleotide
attctaatacgactcactataggctactagccgcgccgcaagcgttttagagctagaaatagcaagttaaaataaggctagtccgttatcaacttgaaaaagtggcaccgagtcggtgc

SEQ ID NO: 2969 - DNA, 23 bp, Artificial Sequence
  Description of Artificial Sequence: Synthetic oligonucleotide
cggctagtagatgacctcggtgg

SEQ ID NO: 2970 - DNA, 119 bp, Artificial Sequence
  Description of Artificial Sequence: Synthetic polynucleotide
attctaatacgactcactataggcggctagtagatgacctcgggttttagagctagaaatagcaagttaaaataaggctagtccgttatcaacttgaaaaagtggcaccgagtcggtgc

SEQ ID NO: 2971 - DNA, 23 bp, Artificial Sequence
  Description of Artificial Sequence: Synthetic oligonucleotide
gcgcggctagtagatgacctcgg

SEQ ID NO: 2972 - DNA, 119 bp, Artificial Sequence
  Description of Artificial Sequence: Synthetic polynucleotide
attctaatacgactcactatagggcgcggctagtagatgacctgttttagagctagaaatagcaagttaaaataaggctagtccgttatcaacttgaaaaagtggcaccgagtcggtgc

SEQ ID NO: 2973 - DNA, 23 bp, Artificial Sequence
  Description of Artificial Sequence: Synthetic oligonucleotide
aggtggacatctggtcggcttgg

SEQ ID NO: 2974 - DNA, 119 bp, Artificial Sequence
  Description of Artificial Sequence: Synthetic polynucleotide
attctaatacgactcactataggaggtggacatctggtcggctgttttagagctagaaatagcaagttaaaataaggctagtccgttatcaacttgaaaaagtggcaccgagtcggtgc

SEQ ID NO: 2975 - DNA, 21 bp, Homo sapiens
ctggtcggctggggtcaccct

SEQ ID NO: 2976 - DNA, 21 bp, Artificial Sequence
  Description of Artificial Sequence: Synthetic oligonucleotide
ctggtcggcttgggtcaccct

SEQ ID NO: 2977 - DNA, 23 bp, Artificial Sequence
  Description of Artificial Sequence: Synthetic oligonucleotide
ggtggacatctggtcggcttggg

SEQ ID NO: 2978 - DNA, 119 bp, Artificial Sequence
  Description of Artificial Sequence: Synthetic polynucleotide
attctaatacgactcactataggggtggacatctggtcggcttgttttagagctagaaatagcaagttaaaataaggctagtccgttatcaacttgaaaaagtggcaccgagtcggtgc

SEQ ID NO: 2979 - DNA, 23 bp, Artificial Sequence
  Description of Artificial Sequence: Synthetic oligonucleotide
ccggaccagccagggcttcccgg

SEQ ID NO: 2980 - DNA, 119 bp, Artificial Sequence
  Description of Artificial Sequence: Synthetic polynucleotide
attctaatacgactcactataggccggaccagccagggcttccgttttagagctagaaatagcaagttaaaataaggctagtccgttatcaacttgaaaaagtggcaccgagtcggtgc

SEQ ID NO: 2981 - DNA, 21 bp, Homo sapiens
agccagggctccccggctttc

SEQ ID NO: 2982 - DNA, 21 bp, Artificial Sequence
  Description of Artificial Sequence: Synthetic oligonucleotide
agccagggcttcccggctttc

SEQ ID NO: 2983 - DNA, 23 bp, Artificial Sequence
  Description of Artificial Sequence: Synthetic oligonucleotide
gaagccctggctggtccggcagg

SEQ ID NO: 2984 - DNA, 119 bp, Artificial Sequence
  Description of Artificial Sequence: Synthetic polynucleotide
attctaatacgactcactatagggaagccctggctggtccggcgttttagagctagaaatagcaagttaaaataaggctagtccgttatcaacttgaaaaagtggcaccgagtcggtgc

SEQ ID NO: 2985 - DNA, 23 bp, Artificial Sequence
  Description of Artificial Sequence: Synthetic oligonucleotide
gctggaaagccgggaagccctgg

SEQ ID NO: 2986 - DNA, 119 bp, Artificial Sequence
  Description of Artificial Sequence: Synthetic polynucleotide
attctaatacgactcactatagggctggaaagccgggaagcccgttttagagctagaaatagcaagttaaaataaggctagtccgttatcaacttgaaaaagtggcaccgagtcggtgc

SEQ ID NO: 2987 - DNA, 23 bp, Artificial Sequence
  Description of Artificial Sequence: Synthetic oligonucleotide
gaaagccgggaagccctggctgg

SEQ ID NO: 2988 - DNA, 119 bp, Artificial Sequence
  Description of Artificial Sequence: Synthetic polynucleotide
attctaatacgactcactatagggaaagccgggaagccctggcgttttagagctagaaatagcaagttaaaataaggctagtccgttatcaacttgaaaaagtggcaccgagtcggtgc

SEQ ID NO: 2989 - DNA, 23 bp, Artificial Sequence
  Description of Artificial Sequence: Synthetic oligonucleotide
ccgggaagccctggctggtccgg

SEQ ID NO: 2990 - DNA, 119 bp, Artificial Sequence
  Description of Artificial Sequence: Synthetic polynucleotide
attctaatacgactcactataggccgggaagccctggctggtcgttttagagctagaaatagcaagttaaaataaggctagtccgttatcaacttgaaaaagtggcaccgagtcggtgc

SEQ ID NO: 2991 - DNA, 23 bp, Artificial Sequence
  Description of Artificial Sequence: Synthetic oligonucleotide
cccaccgcgcccccggcccccgg

SEQ ID NO: 2992 - DNA, 119 bp, Artificial Sequence
  Description of Artificial Sequence: Synthetic polynucleotide
attctaatacgactcactataggcccaccgcgcccccggccccgttttagagctagaaatagcaagttaaaataaggctagtccgttatcaacttgaaaaagtggcaccgagtcggtgc

SEQ ID NO: 2993 - DNA, 21 bp, Homo sapiens
ccccggcccctggcccgactg

SEQ ID NO: 2994 - DNA, 21 bp, Artificial Sequence
  Description of Artificial Sequence: Synthetic oligonucleotide
ccccggcccccggcccgactg

SEQ ID NO: 2995 - DNA, 23 bp, Artificial Sequence
  Description of Artificial Sequence: Synthetic oligonucleotide
ccccggcccgactgcccccccgg

SEQ ID NO: 2996 - DNA, 119 bp, Artificial Sequence
  Description of Artificial Sequence: Synthetic polynucleotide
attctaatacgactcactataggccccggcccgactgccccccgttttagagctagaaatagcaagttaaaataaggctagtccgttatcaacttgaaaaagtggcaccgagtcggtgc

SEQ ID NO: 2997 - DNA, 23 bp, Artificial Sequence
  Description of Artificial Sequence: Synthetic oligonucleotide
gccgggggccgggggcgcggtgg

SEQ ID NO: 2998 - DNA, 119 bp, Artificial Sequence
  Description of Artificial Sequence: Synthetic polynucleotide
attctaatacgactcactatagggccgggggccgggggcgcgggttttagagctagaaatagcaagttaaaataaggctagtccgttatcaacttgaaaaagtggcaccgagtcggtgc

SEQ ID NO: 2999 - DNA, 23 bp, Artificial Sequence
  Description of Artificial Sequence: Synthetic oligonucleotide
ggccgggggggcagtcgggccgg

SEQ ID NO: 3000 - DNA, 119 bp, Artificial Sequence
  Description of Artificial Sequence: Synthetic polynucleotide
attctaatacgactcactataggggccgggggggcagtcgggcgttttagagctagaaatagcaagttaaaataaggctagtccgttatcaacttgaaaaagtggcaccgagtcggtgc

SEQ ID NO: 3001 - DNA, 23 bp, Artificial Sequence
  Description of Artificial Sequence: Synthetic oligonucleotide
ggggcagtcgggccgggggccgg

SEQ ID NO: 3002 - DNA, 119 bp, Artificial Sequence
  Description of Artificial Sequence: Synthetic polynucleotide
attctaatacgactcactataggggggcagtcgggccgggggcgttttagagctagaaatagcaagttaaaataaggctagtccgttatcaacttgaaaaagtggcaccgagtcggtgc

SEQ ID NO: 3003 - DNA, 23 bp, Artificial Sequence
  Description of Artificial Sequence: Synthetic oligonucleotide
cgggccgggggccgggggcgcgg

SEQ ID NO: 3004 - DNA, 119 bp, Artificial Sequence
  Description of Artificial Sequence: Synthetic polynucleotide
attctaatacgactcactataggcgggccgggggccgggggcggttttagagctagaaatagcaagttaaaataaggctagtccgttatcaacttgaaaaagtggcaccgagtcggtgc

SEQ ID NO: 3005 - DNA, 23 bp, Artificial Sequence
  Description of Artificial Sequence: Synthetic oligonucleotide
gccgggggggcagtcgggccggg

SEQ ID NO: 3006 - DNA, 119 bp, Artificial Sequence
  Description of Artificial Sequence: Synthetic polynucleotide
attctaatacgactcactatagggccgggggggcagtcgggccgttttagagctagaaatagcaagttaaaataaggctagtccgttatcaacttgaaaaagtggcaccgagtcggtgc

SEQ ID NO: 3007 - DNA, 23 bp, Artificial Sequence
  Description of Artificial Sequence: Synthetic oligonucleotide
ccgggggggcagtcgggccgggg

SEQ ID NO: 3008 - DNA, 119 bp, Artificial Sequence
  Description of Artificial Sequence: Synthetic polynucleotide
attctaatacgactcactataggccgggggggcagtcgggccggttttagagctagaaatagcaagttaaaataaggctagtccgttatcaacttgaaaaagtggcaccgagtcggtgc

SEQ ID NO: 3009 - DNA, 23 bp, Artificial Sequence
  Description of Artificial Sequence: Synthetic oligonucleotide
cgggggggcagtcgggccggggg

SEQ ID NO: 3010 - DNA, 119 bp, Artificial Sequence
  Description of Artificial Sequence: Synthetic polynucleotide
attctaatacgactcactataggcgggggggcagtcgggccgggttttagagctagaaatagcaagttaaaataaggctagtccgttatcaacttgaaaaagtggcaccgagtcggtgc

SEQ ID NO: 3011 - DNA, 23 bp, Artificial Sequence
  Description of Artificial Sequence: Synthetic oligonucleotide
gggcagtcgggccgggggccggg

SEQ ID NO: 3012 - DNA, 119 bp, Artificial Sequence
  Description of Artificial Sequence: Synthetic polynucleotide
attctaatacgactcactatagggggcagtcgggccgggggccgttttagagctagaaatagcaagttaaaataaggctagtccgttatcaacttgaaaaagtggcaccgagtcggtgc

SEQ ID NO: 3013 - DNA, 23 bp, Artificial Sequence
  Description of Artificial Sequence: Synthetic oligonucleotide
ggcagtcgggccgggggccgggg

SEQ ID NO: 3014 - DNA, 119 bp, Artificial Sequence
  Description of Artificial Sequence: Synthetic polynucleotide
attctaatacgactcactataggggcagtcgggccgggggccggttttagagctagaaatagcaagttaaaataaggctagtccgttatcaacttgaaaaagtggcaccgagtcggtgc

SEQ ID NO: 3015 - DNA, 23 bp, Artificial Sequence
  Description of Artificial Sequence: Synthetic oligonucleotide
gcagtcgggccgggggccggggg

SEQ ID NO: 3016 - DNA, 119 bp, Artificial Sequence
  Description of Artificial Sequence: Synthetic polynucleotide
attctaatacgactcactatagggcagtcgggccgggggccgggttttagagctagaaatagcaagttaaaataaggctagtccgttatcaacttgaaaaagtggcaccgagtcggtgc

SEQ ID NO: 3017 - DNA, 23 bp, Artificial Sequence
  Description of Artificial Sequence: Synthetic oligonucleotide
ccgggggccgggggcgcggtggg

SEQ ID NO: 3018 - DNA, 119 bp, Artificial Sequence
  Description of Artificial Sequence: Synthetic polynucleotide
attctaatacgactcactataggccgggggccgggggcgcggtgttttagagctagaaatagcaagttaaaataaggctagtccgttatcaacttgaaaaagtggcaccgagtcggtgc

SEQ ID NO: 3019 - DNA, 23 bp, Artificial Sequence
  Description of Artificial Sequence: Synthetic oligonucleotide
cgggggccgggggcgcggtgggg

SEQ ID NO: 3020 - DNA, 119 bp, Artificial Sequence
  Description of Artificial Sequence: Synthetic polynucleotide
attctaatacgactcactataggcgggggccgggggcgcggtggttttagagctagaaatagcaagttaaaataaggctagtccgttatcaacttgaaaaagtggcaccgagtcggtgc

SEQ ID NO: 3021 - DNA, 23 bp, Artificial Sequence
  Description of Artificial Sequence: Synthetic oligonucleotide
tttgtctccatgggagtggaagg

SEQ ID NO: 3022 - DNA, 119 bp, Artificial Sequence
  Description of Artificial Sequence: Synthetic polynucleotide
attctaatacgactcactataggtttgtctccatgggagtggagttttagagctagaaatagcaagttaaaataaggctagtccgttatcaacttgaaaaagtggcaccgagtcggtgc

SEQ ID NO: 3023 - DNA, 23 bp, Artificial Sequence
  Description of Artificial Sequence: Synthetic oligonucleotide
ggccatcacgtttgtctccatgg

SEQ ID NO: 3024 - DNA, 119 bp, Artificial Sequence
  Description of Artificial Sequence: Synthetic polynucleotide
attctaatacgactcactataggggccatcacgtttgtctccagttttagagctagaaatagcaagttaaaataaggctagtccgttatcaacttgaaaaagtggcaccgagtcggtgc

SEQ ID NO: 3025 - DNA, 23 bp, Artificial Sequence
  Description of Artificial Sequence: Synthetic oligonucleotide
cacgtttgtctccatgggagtgg

SEQ ID NO: 3026 - DNA, 119 bp, Artificial Sequence
  Description of Artificial Sequence: Synthetic polynucleotide
attctaatacgactcactataggcacgtttgtctccatgggaggttttagagctagaaatagcaagttaaaataaggctagtccgttatcaacttgaaaaagtggcaccgagtcggtgc

SEQ ID NO: 3027 - DNA, 23 bp, Artificial Sequence
  Description of Artificial Sequence: Synthetic oligonucleotide
gccatcacgtttgtctccatggg

SEQ ID NO: 3028 - DNA, 119 bp, Artificial Sequence
  Description of Artificial Sequence: Synthetic polynucleotide
attctaatacgactcactatagggccatcacgtttgtctccatgttttagagctagaaatagcaagttaaaataaggctagtccgttatcaacttgaaaaagtggcaccgagtcggtgc

SEQ ID NO: 3029 - DNA, 23 bp, Artificial Sequence
  Description of Artificial Sequence: Synthetic oligonucleotide
aaaggcgccttccactcccatgg

SEQ ID NO: 3030 - DNA, 119 bp, Artificial Sequence
  Description of Artificial Sequence: Synthetic polynucleotide
attctaatacgactcactataggaaaggcgccttccactcccagttttagagctagaaatagcaagttaaaataaggctagtccgttatcaacttgaaaaagtggcaccgagtcggtgc

SEQ ID NO: 3031 - DNA, 23 bp, Artificial Sequence
  Description of Artificial Sequence: Synthetic oligonucleotide
tcccatggagacaaacgtgatgg

SEQ ID NO: 3032 - DNA, 119 bp, Artificial Sequence
  Description of Artificial Sequence: Synthetic polynucleotide
attctaatacgactcactataggtcccatggagacaaacgtgagttttagagctagaaatagcaagttaaaataaggctagtccgttatcaacttgaaaaagtggcaccgagtcggtgc

SEQ ID NO: 3033 - DNA, 23 bp, Artificial Sequence
  Description of Artificial Sequence: Synthetic oligonucleotide
aatggagaaagatgtaacttcgg

SEQ ID NO: 3034 - DNA, 119 bp, Artificial Sequence
  Description of Artificial Sequence: Synthetic polynucleotide
attctaatacgactcactataggaatggagaaagatgtaacttgttttagagctagaaatagcaagttaaaataaggctagtccgttatcaacttgaaaaagtggcaccgagtcggtgc

SEQ ID NO: 3035 - DNA, 23 bp, Artificial Sequence
  Description of Artificial Sequence: Synthetic oligonucleotide
atggagaaagatgtaacttcggg

SEQ ID NO: 3036 - DNA, 119 bp, Artificial Sequence
  Description of Artificial Sequence: Synthetic polynucleotide
attctaatacgactcactataggatggagaaagatgtaacttcgttttagagctagaaatagcaagttaaaataaggctagtccgttatcaacttgaaaaagtggcaccgagtcggtgc

SEQ ID NO: 3037 - DNA, 23 bp, Artificial Sequence
  Description of Artificial Sequence: Synthetic oligonucleotide
tggagaaagatgtaacttcgggg

SEQ ID NO: 3038 - DNA, 119 bp, Artificial Sequence
  Description of Artificial Sequence: Synthetic polynucleotide
attctaatacgactcactataggtggagaaagatgtaacttcggttttagagctagaaatagcaagttaaaataaggctagtccgttatcaacttgaaaaagtggcaccgagtcggtgc

SEQ ID NO: 3039 - DNA, 23 bp, Artificial Sequence
  Description of Artificial Sequence: Synthetic oligonucleotide
atctttctccattagccttttgg

SEQ ID NO: 3040 - DNA, 119 bp, Artificial Sequence
  Description of Artificial Sequence: Synthetic polynucleotide
attctaatacgactcactataggatctttctccattagcctttgttttagagctagaaatagcaagttaaaataaggctagtccgttatcaacttgaaaaagtggcaccgagtcggtgc

SEQ ID NO: 3041 - DNA, 23 bp, Artificial Sequence
  Description of Artificial Sequence: Synthetic oligonucleotide
attcttatcctggtgtgggaagg

SEQ ID NO: 3042 - DNA, 119 bp, Artificial Sequence
  Description of Artificial Sequence: Synthetic polynucleotide
attctaatacgactcactataggattcttatcctggtgtgggagttttagagctagaaatagcaagttaaaataaggctagtccgttatcaacttgaaaaagtggcaccgagtcggtgc

SEQ ID NO: 3043 - DNA, 21 bp, Homo sapiens
ttgtgattctcatcctggtgt

SEQ ID NO: 3044 - DNA, 21 bp, Artificial Sequence
  Description of Artificial Sequence: Synthetic oligonucleotide
ttgtgattcttatcctggtgt

SEQ ID NO: 3045 - DNA, 23 bp, Artificial Sequence
  Description of Artificial Sequence: Synthetic oligonucleotide
agtgattgtgattcttatcctgg

SEQ ID NO: 3046 - DNA, 119 bp, Artificial Sequence
  Description of Artificial Sequence: Synthetic polynucleotide
attctaatacgactcactataggagtgattgtgattcttatccgttttagagctagaaatagcaagttaaaataaggctagtccgttatcaacttgaaaaagtggcaccgagtcggtgc

SEQ ID NO: 3047 - DNA, 23 bp, Artificial Sequence
  Description of Artificial Sequence: Synthetic oligonucleotide
ttgtgattcttatcctggtgtgg

SEQ ID NO: 3048 - DNA, 119 bp, Artificial Sequence
  Description of Artificial Sequence: Synthetic polynucleotide
attctaatacgactcactataggttgtgattcttatcctggtggttttagagctagaaatagcaagttaaaataaggctagtccgttatcaacttgaaaaagtggcaccgagtcggtgc

SEQ ID NO: 3049 - DNA, 23 bp, Artificial Sequence
  Description of Artificial Sequence: Synthetic oligonucleotide
tgtgattcttatcctggtgtggg

SEQ ID NO: 3050 - DNA, 119 bp, Artificial Sequence
  Description of Artificial Sequence: Synthetic polynucleotide
attctaatacgactcactataggtgtgattcttatcctggtgtgttttagagctagaaatagcaagttaaaataaggctagtccgttatcaacttgaaaaagtggcaccgagtcggtgc

SEQ ID NO: 3051 - DNA, 23 bp, Artificial Sequence
  Description of Artificial Sequence: Synthetic oligonucleotide
tagcattgcagctcgtttactgg

SEQ ID NO: 3052 - DNA, 119 bp, Artificial Sequence
  Description of Artificial Sequence: Synthetic polynucleotide
attctaatacgactcactataggtagcattgcagctcgtttacgttttagagctagaaatagcaagttaaaataaggctagtccgttatcaacttgaaaaagtggcaccgagtcggtgc

SEQ ID NO: 3053 - DNA, 23 bp, Artificial Sequence
  Description of Artificial Sequence: Synthetic oligonucleotide
cagctaggcttacagcattgtgg

SEQ ID NO: 3054 - DNA, 119 bp, Artificial Sequence
  Description of Artificial Sequence: Synthetic polynucleotide
attctaatacgactcactataggcagctaggcttacagcattggttttagagctagaaatagcaagttaaaataaggctagtccgttatcaacttgaaaaagtggcaccgagtcggtgc

SEQ ID NO: 3055 - DNA, 23 bp, Artificial Sequence
  Description of Artificial Sequence: Synthetic oligonucleotide
tttgaaatcaaagagtatcttgg

SEQ ID NO: 3056 - DNA, 119 bp, Artificial Sequence
  Description of Artificial Sequence: Synthetic polynucleotide
attctaatacgactcactataggtttgaaatcaaagagtatctgttttagagctagaaatagcaagttaaaataaggctagtccgttatcaacttgaaaaagtggcaccgagtcggtgc

SEQ ID NO: 3057 - DNA, 23 bp, Artificial Sequence
  Description of Artificial Sequence: Synthetic oligonucleotide
agtatcttggtaaagaagaatgg

SEQ ID NO: 3058 - DNA, 119 bp, Artificial Sequence
  Description of Artificial Sequence: Synthetic polynucleotide
attctaatacgactcactataggagtatcttggtaaagaagaagttttagagctagaaatagcaagttaaaataaggctagtccgttatcaacttgaaaaagtggcaccgagtcggtgc

SEQ ID NO: 3059 - DNA, 23 bp, Artificial Sequence
  Description of Artificial Sequence: Synthetic oligonucleotide
atggtacttggacttagctctgg

SEQ ID NO: 3060 - DNA, 119 bp, Artificial Sequence
  Description of Artificial Sequence: Synthetic polynucleotide
attctaatacgactcactataggatggtacttggacttagctcgttttagagctagaaatagcaagttaaaataaggctagtccgttatcaacttgaaaaagtggcaccgagtcggtgc

SEQ ID NO: 3061 - DNA, 23 bp, Artificial Sequence
  Description of Artificial Sequence: Synthetic oligonucleotide
tacttggacttagctctggttgg

SEQ ID NO: 3062 - DNA, 119 bp, Artificial Sequence
  Description of Artificial Sequence: Synthetic polynucleotide
attctaatacgactcactataggtacttggacttagctctggtgttttagagctagaaatagcaagttaaaataaggctagtccgttatcaacttgaaaaagtggcaccgagtcggtgc

SEQ ID NO: 3063 - DNA, 23 bp, Artificial Sequence
  Description of Artificial Sequence: Synthetic oligonucleotide
acacgcacctcaaagctgttcgg

SEQ ID NO: 3064 - DNA, 119 bp, Artificial Sequence
  Description of Artificial Sequence: Synthetic polynucleotide
attctaatacgactcactataggacacgcacctcaaagctgttgttttagagctagaaatagcaagttaaaataaggctagtccgttatcaacttgaaaaagtggcaccgagtcggtgc

SEQ ID NO: 3065 - DNA, 21 bp, Homo sapiens
aaagctgttccgtcccagtag

SEQ ID NO: 3066 - DNA, 21 bp, Artificial Sequence
  Description of Artificial Sequence: Synthetic oligonucleotide
aaagctgttcggtcccagtag

SEQ ID NO: 3067 - DNA, 23 bp, Artificial Sequence
  Description of Artificial Sequence: Synthetic oligonucleotide
actgggaccgaacagctttgagg

SEQ ID NO: 3068 - DNA, 119 bp, Artificial Sequence
  Description of Artificial Sequence: Synthetic polynucleotide
attctaatacgactcactataggactgggaccgaacagctttggttttagagctagaaatagcaagttaaaataaggctagtccgttatcaacttgaaaaagtggcaccgagtcggtgc

SEQ ID NO: 3069 - DNA, 23 bp, Artificial Sequence
  Description of Artificial Sequence: Synthetic oligonucleotide
ggtacagtcagagccaacccagg

SEQ ID NO: 3070 - DNA, 119 bp, Artificial Sequence
  Description of Artificial Sequence: Synthetic polynucleotide
attctaatacgactcactataggggtacagtcagagccaacccgttttagagctagaaatagcaagttaaaataaggctagtccgttatcaacttgaaaaagtggcaccgagtcggtgc

SEQ ID NO: 3071 - DNA, 21 bp, Homo sapiens
agagccaacctaggagataac

SEQ ID NO: 3072 - DNA, 21 bp, Artificial Sequence
  Description of Artificial Sequence: Synthetic oligonucleotide
agagccaacccaggagataac

SEQ ID NO: 3073 - DNA, 23 bp, Artificial Sequence
  Description of Artificial Sequence: Synthetic oligonucleotide
gccaacccaggagataacacagg

SEQ ID NO: 3074 - DNA, 119 bp, Artificial Sequence
  Description of Artificial Sequence: Synthetic polynucleotide
attctaatacgactcactatagggccaacccaggagataacacgttttagagctagaaatagcaagttaaaataaggctagtccgttatcaacttgaaaaagtggcaccgagtcggtgc

SEQ ID NO: 3075 - DNA, 23 bp, Artificial Sequence
  Description of Artificial Sequence: Synthetic oligonucleotide
cttgggcctgtgttatctcctgg

SEQ ID NO: 3076 - DNA, 119 bp, Artificial Sequence
  Description of Artificial Sequence: Synthetic polynucleotide
attctaatacgactcactataggcttgggcctgtgttatctccgttttagagctagaaatagcaagttaaaataaggctagtccgttatcaacttgaaaaagtggcaccgagtcggtgc

SEQ ID NO: 3077 - DNA, 23 bp, Artificial Sequence
  Description of Artificial Sequence: Synthetic oligonucleotide
gcctgtgttatctcctgggttgg

SEQ ID NO: 3078 - DNA, 119 bp, Artificial Sequence
  Description of Artificial Sequence: Synthetic polynucleotide
attctaatacgactcactatagggcctgtgttatctcctgggtgttttagagctagaaatagcaagttaaaataaggctagtccgttatcaacttgaaaaagtggcaccgagtcggtgc

SEQ ID NO: 3079 - DNA, 23 bp, Artificial Sequence
  Description of Artificial Sequence: Synthetic oligonucleotide
ttgggcctgtgttatctcctggg

SEQ ID NO: 3080 - DNA, 119 bp, Artificial Sequence
  Description of Artificial Sequence: Synthetic polynucleotide
attctaatacgactcactataggttgggcctgtgttatctcctgttttagagctagaaatagcaagttaaaataaggctagtccgttatcaacttgaaaaagtggcaccgagtcggtgc

SEQ ID NO: 3081 - DNA, 23 bp, Artificial Sequence
  Description of Artificial Sequence: Synthetic oligonucleotide
aaacacttttcgacatattgtgg

SEQ ID NO: 3082 - DNA, 119 bp, Artificial Sequence
  Description of Artificial Sequence: Synthetic polynucleotide
attctaatacgactcactataggaaacacttttcgacatattggttttagagctagaaatagcaagttaaaataaggctagtccgttatcaacttgaaaaagtggcaccgagtcggtgc

SEQ ID NO: 3083 - DNA, 23 bp, Artificial Sequence
  Description of Artificial Sequence: Synthetic oligonucleotide
cacttttcgacatattgtggtgg

SEQ ID NO: 3084 - DNA, 119 bp, Artificial Sequence
  Description of Artificial Sequence: Synthetic polynucleotide
attctaatacgactcactataggcacttttcgacatattgtgggttttagagctagaaatagcaagttaaaataaggctagtccgttatcaacttgaaaaagtggcaccgagtcggtgc

SEQ ID NO: 3085 - DNA, 23 bp, Artificial Sequence
  Description of Artificial Sequence: Synthetic oligonucleotide
gcttgtagatggccatggcgagg

SEQ ID NO: 3086 - DNA, 119 bp, Artificial Sequence
  Description of Artificial Sequence: Synthetic polynucleotide
attctaatacgactcactatagggcttgtagatggccatggcggttttagagctagaaatagcaagttaaaataaggctagtccgttatcaacttgaaaaagtggcaccgagtcggtgc

SEQ ID NO: 3087 - DNA, 21 bp, Homo sapiens
ggccatggcgcggacgcgggt

SEQ ID NO: 3088 - DNA, 21 bp, Artificial Sequence
  Description of Artificial Sequence: Synthetic oligonucleotide
ggccatggcgaggacgcgggt

SEQ ID NO: 3089 - DNA, 23 bp, Artificial Sequence
  Description of Artificial Sequence: Synthetic oligonucleotide
agatggccatggcgaggacgcgg

SEQ ID NO: 3090 - DNA, 119 bp, Artificial Sequence
  Description of Artificial Sequence: Synthetic polynucleotide
attctaatacgactcactataggagatggccatggcgaggacggttttagagctagaaatagcaagttaaaataaggctagtccgttatcaacttgaaaaagtggcaccgagtcggtgc

SEQ ID NO: 3091 - DNA, 23 bp, Artificial Sequence
  Description of Artificial Sequence: Synthetic oligonucleotide
catggcgaggacgcgggtgccgg

SEQ ID NO: 3092 - DNA, 119 bp, Artificial Sequence
  Description of Artificial Sequence: Synthetic polynucleotide
attctaatacgactcactataggcatggcgaggacgcgggtgcgttttagagctagaaatagcaagttaaaataaggctagtccgttatcaacttgaaaaagtggcaccgagtcggtgc

SEQ ID NO: 3093 - DNA, 23 bp, Artificial Sequence
  Description of Artificial Sequence: Synthetic oligonucleotide
gcgaggacgcgggtgccgggcgg

SEQ ID NO: 3094 - DNA, 119 bp, Artificial Sequence
  Description of Artificial Sequence: Synthetic polynucleotide
attctaatacgactcactatagggcgaggacgcgggtgccggggttttagagctagaaatagcaagttaaaataaggctagtccgttatcaacttgaaaaagtggcaccgagtcggtgc

SEQ ID NO: 3095 - DNA, 23 bp, Artificial Sequence
  Description of Artificial Sequence: Synthetic oligonucleotide
gatggccatggcgaggacgcggg

SEQ ID NO: 3096 - DNA, 119 bp, Artificial Sequence
  Description of Artificial Sequence: Synthetic polynucleotide
attctaatacgactcactatagggatggccatggcgaggacgcgttttagagctagaaatagcaagttaaaataaggctagtccgttatcaacttgaaaaagtggcaccgagtcggtgc

SEQ ID NO: 3097 - DNA, 23 bp, Artificial Sequence
  Description of Artificial Sequence: Synthetic oligonucleotide
atggcgaggacgcgggtgccggg

SEQ ID NO: 3098 - DNA, 119 bp, Artificial Sequence
  Description of Artificial Sequence: Synthetic polynucleotide
attctaatacgactcactataggatggcgaggacgcgggtgccgttttagagctagaaatagcaagttaaaataaggctagtccgttatcaacttgaaaaagtggcaccgagtcggtgc

SEQ ID NO: 3099 - DNA, 23 bp, Artificial Sequence
  Description of Artificial Sequence: Synthetic oligonucleotide
cgaggacgcgggtgccgggcggg

SEQ ID NO: 3100 - DNA, 119 bp, Artificial Sequence
  Description of Artificial Sequence: Synthetic polynucleotide
attctaatacgactcactataggcgaggacgcgggtgccgggcgttttagagctagaaatagcaagttaaaataaggctagtccgttatcaacttgaaaaagtggcaccgagtcggtgc

SEQ ID NO: 3101 - DNA, 23 bp, Artificial Sequence
  Description of Artificial Sequence: Synthetic oligonucleotide
gaggacgcgggtgccgggcgggg

SEQ ID NO: 3102 - DNA, 119 bp, Artificial Sequence
  Description of Artificial Sequence: Synthetic polynucleotide
attctaatacgactcactatagggaggacgcgggtgccgggcggttttagagctagaaatagcaagttaaaataaggctagtccgttatcaacttgaaaaagtggcaccgagtcggtgc

SEQ ID NO: 3103 - DNA, 23 bp, Artificial Sequence
  Description of Artificial Sequence: Synthetic oligonucleotide
aggacgcgggtgccgggcggggg

SEQ ID NO: 3104 - DNA, 119 bp, Artificial Sequence
  Description of Artificial Sequence: Synthetic polynucleotide
attctaatacgactcactataggaggacgcgggtgccgggcgggttttagagctagaaatagcaagttaaaataaggctagtccgttatcaacttgaaaaagtggcaccgagtcggtgc

SEQ ID NO: 3105 - DNA, 23 bp, Artificial Sequence
  Description of Artificial Sequence: Synthetic oligonucleotide
cggcacccgcgtcctcgccatgg

SEQ ID NO: 3106 - DNA, 119 bp, Artificial Sequence
  Description of Artificial Sequence: Synthetic polynucleotide
attctaatacgactcactataggcggcacccgcgtcctcgccagttttagagctagaaatagcaagttaaaataaggctagtccgttatcaacttgaaaaagtggcaccgagtcggtgc

SEQ ID NO: 3107 - DNA, 23 bp, Artificial Sequence
  Description of Artificial Sequence: Synthetic oligonucleotide
gtgcatgtttgtgcctgtcctgg

SEQ ID NO: 3108 - DNA, 119 bp, Artificial Sequence
  Description of Artificial Sequence: Synthetic polynucleotide
attctaatacgactcactatagggtgcatgtttgtgcctgtccgttttagagctagaaatagcaagttaaaataaggctagtccgttatcaacttgaaaaagtggcaccgagtcggtgc

SEQ ID NO: 3109 - DNA, 23 bp, Artificial Sequence
  Description of Artificial Sequence: Synthetic oligonucleotide
tgcatgtttgtgcctgtcctggg

SEQ ID NO: 3110 - DNA, 119 bp, Artificial Sequence
  Description of Artificial Sequence: Synthetic polynucleotide
attctaatacgactcactataggtgcatgtttgtgcctgtcctgttttagagctagaaatagcaagttaaaataaggctagtccgttatcaacttgaaaaagtggcaccgagtcggtgc

SEQ ID NO: 3111 - DNA, 23 bp, Artificial Sequence
  Description of Artificial Sequence: Synthetic oligonucleotide
ccggttcatgccgcccatgcggg

SEQ ID NO: 3112 - DNA, 119 bp, Artificial Sequence
  Description of Artificial Sequence: Synthetic polynucleotide
attctaatacgactcactataggccggttcatgccgcccatgcgttttagagctagaaatagcaagttaaaataaggctagtccgttatcaacttgaaaaagtggcaccgagtcggtgc

SEQ ID NO: 3113 - DNA, 23 bp, Artificial Sequence
  Description of Artificial Sequence: Synthetic oligonucleotide
catgtgtaacagttcccgcatgg

SEQ ID NO: 3114 - DNA, 119 bp, Artificial Sequence
  Description of Artificial Sequence: Synthetic polynucleotide
attctaatacgactcactataggcatgtgtaacagttcccgcagttttagagctagaaatagcaagttaaaataaggctagtccgttatcaacttgaaaaagtggcaccgagtcggtgc

SEQ ID NO: 3115 - DNA, 23 bp, Artificial Sequence
  Description of Artificial Sequence: Synthetic oligonucleotide
tgtaacagttcccgcatgggcgg

SEQ ID NO: 3116 - DNA, 119 bp, Artificial Sequence
  Description of Artificial Sequence: Synthetic polynucleotide
attctaatacgactcactataggtgtaacagttcccgcatggggttttagagctagaaatagcaagttaaaataaggctagtccgttatcaacttgaaaaagtggcaccgagtcggtgc

SEQ ID NO: 3117 - DNA, 23 bp, Artificial Sequence
  Description of Artificial Sequence: Synthetic oligonucleotide
cccgcatgggcggcatgaaccgg

SEQ ID NO: 3118 - DNA, 119 bp, Artificial Sequence
  Description of Artificial Sequence: Synthetic polynucleotide
attctaatacgactcactataggcccgcatgggcggcatgaacgttttagagctagaaatagcaagttaaaataaggctagtccgttatcaacttgaaaaagtggcaccgagtcggtgc

SEQ ID NO: 3119 - DNA, 23 bp, Artificial Sequence
  Description of Artificial Sequence: Synthetic oligonucleotide
atgtgtaacagttcccgcatggg

SEQ ID NO: 3120 - DNA, 119 bp, Artificial Sequence
  Description of Artificial Sequence: Synthetic polynucleotide
attctaatacgactcactataggatgtgtaacagttcccgcatgttttagagctagaaatagcaagttaaaataaggctagtccgttatcaacttgaaaaagtggcaccgagtcggtgc

SEQ ID NO: 3121 - DNA, 23 bp, Artificial Sequence
  Description of Artificial Sequence: Synthetic oligonucleotide
gcgggtgccgggcggggatgtgg

SEQ ID NO: 3122 - DNA, 119 bp, Artificial Sequence
  Description of Artificial Sequence: Synthetic polynucleotide
attctaatacgactcactatagggcgggtgccgggcggggatggttttagagctagaaatagcaagttaaaataaggctagtccgttatcaacttgaaaaagtggcaccgagtcggtgc

SEQ ID NO: 3123 - DNA, 21 bp, Homo sapiens
ccgggcgggggtgtggaatca

SEQ ID NO: 3124 - DNA, 21 bp, Artificial Sequence
  Description of Artificial Sequence: Synthetic oligonucleotide
ccgggcggggatgtggaatca

SEQ ID NO: 3125 - DNA, 23 bp, Artificial Sequence
  Description of Artificial Sequence: Synthetic oligonucleotide
gttgattccacatccccgcccgg

SEQ ID NO: 3126 - DNA, 119 bp, Artificial Sequence
  Description of Artificial Sequence: Synthetic polynucleotide
attctaatacgactcactatagggttgattccacatccccgccgttttagagctagaaatagcaagttaaaataaggctagtccgttatcaacttgaaaaagtggcaccgagtcggtgc

SEQ ID NO: 3127 - DNA, 23 bp, Artificial Sequence
  Description of Artificial Sequence: Synthetic oligonucleotide
tgatggtgaggatgggcctcagg

SEQ ID NO: 3128 - DNA, 119 bp, Artificial Sequence
  Description of Artificial Sequence: Synthetic polynucleotide
attctaatacgactcactataggtgatggtgaggatgggcctcgttttagagctagaaatagcaagttaaaataaggctagtccgttatcaacttgaaaaagtggcaccgagtcggtgc

SEQ ID NO: 3129 - DNA, 21 bp, Homo sapiens
gatgggcctccggttcatgcc

SEQ ID NO: 3130 - DNA, 21 bp, Artificial Sequence
  Description of Artificial Sequence: Synthetic oligonucleotide
gatgggcctcaggttcatgcc

SEQ ID NO: 3131 - DNA, 23 bp, Artificial Sequence
  Description of Artificial Sequence: Synthetic oligonucleotide
caggttcatgccgcccatgcagg

SEQ ID NO: 3132 - DNA, 119 bp, Artificial Sequence
  Description of Artificial Sequence: Synthetic polynucleotide
attctaatacgactcactataggcaggttcatgccgcccatgcgttttagagctagaaatagcaagttaaaataaggctagtccgttatcaacttgaaaaagtggcaccgagtcggtgc

SEQ ID NO: 3133 - DNA, 23 bp, Artificial Sequence
  Description of Artificial Sequence: Synthetic oligonucleotide
gcatgggcggcatgaacctgagg

SEQ ID NO: 3134 - DNA, 119 bp, Artificial Sequence
  Description of Artificial Sequence: Synthetic polynucleotide
attctaatacgactcactatagggcatgggcggcatgaacctggttttagagctagaaatagcaagttaaaataaggctagtccgttatcaacttgaaaaagtggcaccgagtcggtgc

SEQ ID NO: 3135 - DNA, 23 bp, Artificial Sequence
  Description of Artificial Sequence: Synthetic oligonucleotide
ggcattctgggagcttaatctgg

SEQ ID NO: 3136 - DNA, 119 bp, Artificial Sequence
  Description of Artificial Sequence: Synthetic polynucleotide
attctaatacgactcactataggggcattctgggagcttaatcgttttagagctagaaatagcaagttaaaataaggctagtccgttatcaacttgaaaaagtggcaccgagtcggtgc

SEQ ID NO: 3137 - DNA, 21 bp, Homo sapiens
ctgggagcttcatctggacct

SEQ ID NO: 3138 - DNA, 21 bp, Artificial Sequence
  Description of Artificial Sequence: Synthetic oligonucleotide
ctgggagcttaatctggacct

SEQ ID NO: 3139 - DNA, 23 bp, Artificial Sequence
  Description of Artificial Sequence: Synthetic oligonucleotide
ctgggagcttaatctggacctgg

SEQ ID NO: 3140 - DNA, 119 bp, Artificial Sequence
  Description of Artificial Sequence: Synthetic polynucleotide
attctaatacgactcactataggctgggagcttaatctggaccgttttagagctagaaatagcaagttaaaataaggctagtccgttatcaacttgaaaaagtggcaccgagtcggtgc

SEQ ID NO: 3141 - DNA, 23 bp, Artificial Sequence
  Description of Artificial Sequence: Synthetic oligonucleotide
tgggagcttaatctggacctggg

SEQ ID NO: 3142 - DNA, 119 bp, Artificial Sequence
  Description of Artificial Sequence: Synthetic polynucleotide
attctaatacgactcactataggtgggagcttaatctggacctgttttagagctagaaatagcaagttaaaataaggctagtccgttatcaacttgaaaaagtggcaccgagtcggtgc

SEQ ID NO: 3143 - DNA, 23 bp, Artificial Sequence
  Description of Artificial Sequence: Synthetic oligonucleotide
ttaagctcccagaatgccagagg

SEQ ID NO: 3144 - DNA, 119 bp, Artificial Sequence
  Description of Artificial Sequence: Synthetic polynucleotide
attctaatacgactcactataggttaagctcccagaatgccaggttttagagctagaaatagcaagttaaaataaggctagtccgttatcaacttgaaaaagtggcaccgagtcggtgc

SEQ ID NO: 3145 - DNA, 23 bp, Artificial Sequence
  Description of Artificial Sequence: Synthetic oligonucleotide
ggtgccctatgagccgcctgagg

SEQ ID NO: 3146 - DNA, 119 bp, Artificial Sequence
  Description of Artificial Sequence: Synthetic polynucleotide
attctaatacgactcactataggggtgccctatgagccgcctggttttagagctagaaatagcaagttaaaataaggctagtccgttatcaacttgaaaaagtggcaccgagtcggtgc

SEQ ID NO: 3147 - DNA, 23 bp, Artificial Sequence
  Description of Artificial Sequence: Synthetic oligonucleotide
tccactcggataagatgctgagg

SEQ ID NO: 3148 - DNA, 119 bp, Artificial Sequence
  Description of Artificial Sequence: Synthetic polynucleotide
attctaatacgactcactataggtccactcggataagatgctggttttagagctagaaatagcaagttaaaataaggctagtccgttatcaacttgaaaaagtggcaccgagtcggtgc

SEQ ID NO: 3149 - DNA, 23 bp, Artificial Sequence
  Description of Artificial Sequence: Synthetic oligonucleotide
ccactcggataagatgctgaggg

SEQ ID NO: 3150 - DNA, 119 bp, Artificial Sequence
  Description of Artificial Sequence: Synthetic polynucleotide
attctaatacgactcactataggccactcggataagatgctgagttttagagctagaaatagcaagttaaaataaggctagtccgttatcaacttgaaaaagtggcaccgagtcggtgc

SEQ ID NO: 3151 - DNA, 23 bp, Artificial Sequence
  Description of Artificial Sequence: Synthetic oligonucleotide
cactcggataagatgctgagggg

SEQ ID NO: 3152 - DNA, 119 bp, Artificial Sequence
  Description of Artificial Sequence: Synthetic polynucleotide
attctaatacgactcactataggcactcggataagatgctgaggttttagagctagaaatagcaagttaaaataaggctagtccgttatcaacttgaaaaagtggcaccgagtcggtgc

SEQ ID NO: 3153 - DNA, 23 bp, Artificial Sequence
  Description of Artificial Sequence: Synthetic oligonucleotide
cagcatcttatccgagtggaagg

SEQ ID NO: 3154 - DNA, 119 bp, Artificial Sequence
  Description of Artificial Sequence: Synthetic polynucleotide
attctaatacgactcactataggcagcatcttatccgagtggagttttagagctagaaatagcaagttaaaataaggctagtccgttatcaacttgaaaaagtggcaccgagtcggtgc

SEQ ID NO: 3155 - DNA, 23 bp, Artificial Sequence
  Description of Artificial Sequence: Synthetic oligonucleotide
ccctcagcatcttatccgagtgg

SEQ ID NO: 3156 - DNA, 119 bp, Artificial Sequence
  Description of Artificial Sequence: Synthetic polynucleotide
attctaatacgactcactataggccctcagcatcttatccgaggttttagagctagaaatagcaagttaaaataaggctagtccgttatcaacttgaaaaagtggcaccgagtcggtgc

SEQ ID NO: 3157 - DNA, 23 bp, Artificial Sequence
  Description of Artificial Sequence: Synthetic oligonucleotide
tggaaaggggtgactcgctctgg

SEQ ID NO: 3158 - DNA, 119 bp, Artificial Sequence
  Description of Artificial Sequence: Synthetic polynucleotide
attctaatacgactcactataggtggaaaggggtgactcgctcgttttagagctagaaatagcaagttaaaataaggctagtccgttatcaacttgaaaaagtggcaccgagtcggtgc

SEQ ID NO: 3159 - DNA, 23 bp, Artificial Sequence
  Description of Artificial Sequence: Synthetic oligonucleotide
ggggtgactcgctctggccatgg

SEQ ID NO: 3160 - DNA, 119 bp, Artificial Sequence
  Description of Artificial Sequence: Synthetic polynucleotide
attctaatacgactcactataggggggtgactcgctctggccagttttagagctagaaatagcaagttaaaataaggctagtccgttatcaacttgaaaaagtggcaccgagtcggtgc

SEQ ID NO: 3161 - DNA, 23 bp, Artificial Sequence
  Description of Artificial Sequence: Synthetic oligonucleotide
gctggcggcactgccgctcccgg

SEQ ID NO: 3162 - DNA, 119 bp, Artificial Sequence
  Description of Artificial Sequence: Synthetic polynucleotide
attctaatacgactcactatagggctggcggcactgccgctccgttttagagctagaaatagcaagttaaaataaggctagtccgttatcaacttgaaaaagtggcaccgagtcggtgc

SEQ ID NO: 3163 - DNA, 21 bp, Homo sapiens
ggctggcggcgctgccgctcc

SEQ ID NO: 3164 - DNA, 21 bp, Artificial Sequence
  Description of Artificial Sequence: Synthetic oligonucleotide
ggctggcggcactgccgctcc

SEQ ID NO: 3165 - DNA, 23 bp, Artificial Sequence
  Description of Artificial Sequence: Synthetic oligonucleotide
gcggcactgccgctcccgggcgg

SEQ ID NO: 3166 - DNA, 119 bp, Artificial Sequence
  Description of Artificial Sequence: Synthetic polynucleotide
attctaatacgactcactatagggcggcactgccgctcccggggttttagagctagaaatagcaagttaaaataaggctagtccgttatcaacttgaaaaagtggcaccgagtcggtgc

SEQ ID NO: 3167 - DNA, 23 bp, Artificial Sequence
  Description of Artificial Sequence: Synthetic oligonucleotide
ctggcggcactgccgctcccggg

SEQ ID NO: 3168 - DNA, 119 bp, Artificial Sequence
  Description of Artificial Sequence: Synthetic polynucleotide
attctaatacgactcactataggctggcggcactgccgctcccgttttagagctagaaatagcaagttaaaataaggctagtccgttatcaacttgaaaaagtggcaccgagtcggtgc

SEQ ID NO: 3169 - DNA, 23 bp, Artificial Sequence
  Description of Artificial Sequence: Synthetic oligonucleotide
ggctggcacagcggtagatgagg

SEQ ID NO: 3170 - DNA, 119 bp, Artificial Sequence
  Description of Artificial Sequence: Synthetic polynucleotide
attctaatacgactcactataggggctggcacagcggtagatggttttagagctagaaatagcaagttaaaataaggctagtccgttatcaacttgaaaaagtggcaccgagtcggtgc

SEQ ID NO: 3171 - DNA, 21 bp, Homo sapiens
gggcctcatccaccgctgtgc

SEQ ID NO: 3172 - DNA, 21 bp, Artificial Sequence
  Description of Artificial Sequence: Synthetic oligonucleotide
gggcctcatctaccgctgtgc

SEQ ID NO: 3173 - DNA, 23 bp, Artificial Sequence
  Description of Artificial Sequence: Synthetic oligonucleotide
ggtagatgaggccctgctccagg

SEQ ID NO: 3174 - DNA, 119 bp, Artificial Sequence
  Description of Artificial Sequence: Synthetic polynucleotide
attctaatacgactcactataggggtagatgaggccctgctccgttttagagctagaaatagcaagttaaaataaggctagtccgttatcaacttgaaaaagtggcaccgagtcggtgc

SEQ ID NO: 3175 - DNA, 23 bp, Artificial Sequence
  Description of Artificial Sequence: Synthetic oligonucleotide
ccataaactttctgctgtcttgg

SEQ ID NO: 3176 - DNA, 119 bp, Artificial Sequence
  Description of Artificial Sequence: Synthetic polynucleotide
attctaatacgactcactataggccataaactttctgctgtctgttttagagctagaaatagcaagttaaaataaggctagtccgttatcaacttgaaaaagtggcaccgagtcggtgc

SEQ ID NO: 3177 - DNA, 23 bp, Artificial Sequence
  Description of Artificial Sequence: Synthetic oligonucleotide
cataaactttctgctgtcttggg

SEQ ID NO: 3178 - DNA, 119 bp, Artificial Sequence
  Description of Artificial Sequence: Synthetic polynucleotide
attctaatacgactcactataggcataaactttctgctgtcttgttttagagctagaaatagcaagttaaaataaggctagtccgttatcaacttgaaaaagtggcaccgagtcggtgc

SEQ ID NO: 3179 - DNA, 23 bp, Artificial Sequence
  Description of Artificial Sequence: Synthetic oligonucleotide
cagaaagtttatggtttcggagg

SEQ ID NO: 3180 - DNA, 119 bp, Artificial Sequence
  Description of Artificial Sequence: Synthetic polynucleotide
attctaatacgactcactataggcagaaagtttatggtttcgggttttagagctagaaatagcaagttaaaataaggctagtccgttatcaacttgaaaaagtggcaccgagtcggtgc

SEQ ID NO: 3181 - DNA, 23 bp, Artificial Sequence
  Description of Artificial Sequence: Synthetic oligonucleotide
ccaagacagcagaaagtttatgg

SEQ ID NO: 3182 - DNA, 119 bp, Artificial Sequence
  Description of Artificial Sequence: Synthetic polynucleotide
attctaatacgactcactataggccaagacagcagaaagtttagttttagagctagaaatagcaagttaaaataaggctagtccgttatcaacttgaaaaagtggcaccgagtcggtgc

SEQ ID NO: 3183 - DNA, 23 bp, Artificial Sequence
  Description of Artificial Sequence: Synthetic oligonucleotide
cagcagaaagtttatggtttcgg

SEQ ID NO: 3184 - DNA, 119 bp, Artificial Sequence
  Description of Artificial Sequence: Synthetic polynucleotide
attctaatacgactcactataggcagcagaaagtttatggtttgttttagagctagaaatagcaagttaaaataaggctagtccgttatcaacttgaaaaagtggcaccgagtcggtgc

SEQ ID NO: 3185 - DNA, 23 bp, Artificial Sequence
  Description of Artificial Sequence: Synthetic oligonucleotide
tatggtttcggaggcccgaccgg

SEQ ID NO: 3186 - DNA, 119 bp, Artificial Sequence
  Description of Artificial Sequence: Synthetic polynucleotide
attctaatacgactcactataggtatggtttcggaggcccgacgttttagagctagaaatagcaagttaaaataaggctagtccgttatcaacttgaaaaagtggcaccgagtcggtgc

SEQ ID NO: 3187 - DNA, 23 bp, Artificial Sequence
  Description of Artificial Sequence: Synthetic oligonucleotide
tcaactatgtcagtttgtaatgg

SEQ ID NO: 3188 - DNA, 119 bp, Artificial Sequence
  Description of Artificial Sequence: Synthetic polynucleotide
attctaatacgactcactataggtcaactatgtcagtttgtaagttttagagctagaaatagcaagttaaaataaggctagtccgttatcaacttgaaaaagtggcaccgagtcggtgc

SEQ ID NO: 3189 - DNA, 23 bp, Artificial Sequence
  Description of Artificial Sequence: Synthetic oligonucleotide
ggaagtccccattggccagcagg

SEQ ID NO: 3190 - DNA, 119 bp, Artificial Sequence
  Description of Artificial Sequence: Synthetic polynucleotide
attctaatacgactcactataggggaagtccccattggccagcgttttagagctagaaatagcaagttaaaataaggctagtccgttatcaacttgaaaaagtggcaccgagtcggtgc

SEQ ID NO: 3191 - DNA, 21 bp, Homo sapiens
attgccaggaggtccccattg

SEQ ID NO: 3192 - DNA, 21 bp, Artificial Sequence
  Description of Artificial Sequence: Synthetic oligonucleotide
attgccaggaagtccccattg

SEQ ID NO: 3193 - DNA, 23 bp, Artificial Sequence
  Description of Artificial Sequence: Synthetic oligonucleotide
cattgccaggaagtccccattgg

SEQ ID NO: 3194 - DNA, 119 bp, Artificial Sequence
  Description of Artificial Sequence: Synthetic polynucleotide
attctaatacgactcactataggcattgccaggaagtccccatgttttagagctagaaatagcaagttaaaataaggctagtccgttatcaacttgaaaaagtggcaccgagtcggtgc

SEQ ID NO: 3195 - DNA, 23 bp, Artificial Sequence
  Description of Artificial Sequence: Synthetic oligonucleotide
gctggccaatggggacttcctgg

SEQ ID NO: 3196 - DNA, 119 bp, Artificial Sequence
  Description of Artificial Sequence: Synthetic polynucleotide
attctaatacgactcactatagggctggccaatggggacttccgttttagagctagaaatagcaagttaaaataaggctagtccgttatcaacttgaaaaagtggcaccgagtcggtgc

SEQ ID NO: 3197 - DNA, 23 bp, Artificial Sequence
  Description of Artificial Sequence: Synthetic oligonucleotide
caatggggacttcctggcaatgg

SEQ ID NO: 3198 - DNA, 119 bp, Artificial Sequence
  Description of Artificial Sequence: Synthetic polynucleotide
attctaatacgactcactataggcaatggggacttcctggcaagttttagagctagaaatagcaagttaaaataaggctagtccgttatcaacttgaaaaagtggcaccgagtcggtgc

SEQ ID NO: 3199 - DNA, 23 bp, Artificial Sequence
  Description of Artificial Sequence: Synthetic oligonucleotide
aatggggacttcctggcaatggg

SEQ ID NO: 3200 - DNA, 119 bp, Artificial Sequence
  Description of Artificial Sequence: Synthetic polynucleotide
attctaatacgactcactataggaatggggacttcctggcaatgttttagagctagaaatagcaagttaaaataaggctagtccgttatcaacttgaaaaagtggcaccgagtcggtgc

SEQ ID NO: 3201 - DNA, 23 bp, Artificial Sequence
  Description of Artificial Sequence: Synthetic oligonucleotide
tatgctgttgggaaacgatatgg

SEQ ID NO: 3202 - DNA, 119 bp, Artificial Sequence
  Description of Artificial Sequence: Synthetic polynucleotide
attctaatacgactcactataggtatgctgttgggaaacgatagttttagagctagaaatagcaagttaaaataaggctagtccgttatcaacttgaaaaagtggcaccgagtcggtgc

SEQ ID NO: 3203 - DNA, 23 bp, Artificial Sequence
  Description of Artificial Sequence: Synthetic oligonucleotide
gccaccgccgccgccgccgctgg

SEQ ID NO: 3204 - DNA, 119 bp, Artificial Sequence
  Description of Artificial Sequence: Synthetic polynucleotide
attctaatacgactcactatagggccaccgccgccgccgccgcgttttagagctagaaatagcaagttaaaataaggctagtccgttatcaacttgaaaaagtggcaccgagtcggtgc

SEQ ID NO: 3205 - DNA, 21 bp, Homo sapiens
gccgccgccggtggggacgtg

SEQ ID NO: 3206 - DNA, 21 bp, Artificial Sequence
  Description of Artificial Sequence: Synthetic oligonucleotide
gccgccgccgctggggacgtg

SEQ ID NO: 3207 - DNA, 23 bp, Artificial Sequence
  Description of Artificial Sequence: Synthetic oligonucleotide
ccaccgccgccgccgccgctggg

SEQ ID NO: 3208 - DNA, 119 bp, Artificial Sequence
  Description of Artificial Sequence: Synthetic polynucleotide
attctaatacgactcactataggccaccgccgccgccgccgctgttttagagctagaaatagcaagttaaaataaggctagtccgttatcaacttgaaaaagtggcaccgagtcggtgc

SEQ ID NO: 3209 - DNA, 23 bp, Artificial Sequence
  Description of Artificial Sequence: Synthetic oligonucleotide
caccgccgccgccgccgctgggg

SEQ ID NO: 3210 - DNA, 119 bp, Artificial Sequence
  Description of Artificial Sequence: Synthetic polynucleotide
attctaatacgactcactataggcaccgccgccgccgccgctggttttagagctagaaatagcaagttaaaataaggctagtccgttatcaacttgaaaaagtggcaccgagtcggtgc

SEQ ID NO: 3211 - DNA, 23 bp, Artificial Sequence
  Description of Artificial Sequence: Synthetic oligonucleotide
cccagcggcggcggcggcggtgg

SEQ ID NO: 3212 - DNA, 119 bp, Artificial Sequence
  Description of Artificial Sequence: Synthetic polynucleotide
attctaatacgactcactataggcccagcggcggcggcggcgggttttagagctagaaatagcaagttaaaataaggctagtccgttatcaacttgaaaaagtggcaccgagtcggtgc

SEQ ID NO: 3213 - DNA, 23 bp, Artificial Sequence
  Description of Artificial Sequence: Synthetic oligonucleotide
atggtgcttcacgtccccagcgg

SEQ ID NO: 3214 - DNA, 119 bp, Artificial Sequence
  Description of Artificial Sequence: Synthetic polynucleotide
attctaatacgactcactataggatggtgcttcacgtccccaggttttagagctagaaatagcaagttaaaataaggctagtccgttatcaacttgaaaaagtggcaccgagtcggtgc

SEQ ID NO: 3215 - DNA, 23 bp, Artificial Sequence
  Description of Artificial Sequence: Synthetic oligonucleotide
gtgcttcacgtccccagcggcgg

SEQ ID NO: 3216 - DNA, 119 bp, Artificial Sequence
  Description of Artificial Sequence: Synthetic polynucleotide
attctaatacgactcactatagggtgcttcacgtccccagcgggttttagagctagaaatagcaagttaaaataaggctagtccgttatcaacttgaaaaagtggcaccgagtcggtgc

SEQ ID NO: 3217 - DNA, 23 bp, Artificial Sequence
  Description of Artificial Sequence: Synthetic oligonucleotide
cttcacgtccccagcggcggcgg

SEQ ID NO: 3218 - DNA, 119 bp, Artificial Sequence
  Description of Artificial Sequence: Synthetic polynucleotide
attctaatacgactcactataggcttcacgtccccagcggcgggttttagagctagaaatagcaagttaaaataaggctagtccgttatcaacttgaaaaagtggcaccgagtcggtgc

SEQ ID NO: 3219 - DNA, 23 bp, Artificial Sequence
  Description of Artificial Sequence: Synthetic oligonucleotide
cacgtccccagcggcggcggcgg

SEQ ID NO: 3220 - DNA, 119 bp, Artificial Sequence
  Description of Artificial Sequence: Synthetic polynucleotide
attctaatacgactcactataggcacgtccccagcggcggcgggttttagagctagaaatagcaagttaaaataaggctagtccgttatcaacttgaaaaagtggcaccgagtcggtgc

SEQ ID NO: 3221 - DNA, 23 bp, Artificial Sequence
  Description of Artificial Sequence: Synthetic oligonucleotide
gtccccagcggcggcggcggcgg

SEQ ID NO: 3222 - DNA, 119 bp, Artificial Sequence
  Description of Artificial Sequence: Synthetic polynucleotide
attctaatacgactcactatagggtccccagcggcggcggcgggttttagagctagaaatagcaagttaaaataaggctagtccgttatcaacttgaaaaagtggcaccgagtcggtgc

SEQ ID NO: 3223 - DNA, 23 bp, Artificial Sequence
  Description of Artificial Sequence: Synthetic oligonucleotide
gccaccgccgccgccgccggcgg

SEQ ID NO: 3224 - DNA, 119 bp, Artificial Sequence
  Description of Artificial Sequence: Synthetic polynucleotide
attctaatacgactcactatagggccaccgccgccgccgccgggttttagagctagaaatagcaagttaaaataaggctagtccgttatcaacttgaaaaagtggcaccgagtcggtgc

SEQ ID NO: 3225 - DNA, 21 bp, Homo sapiens
ccgccgccggtggggacgtga

SEQ ID NO: 3226 - DNA, 21 bp, Artificial Sequence
  Description of Artificial Sequence: Synthetic oligonucleotide
ccgccgccggcggggacgtga

SEQ ID NO: 3227 - DNA, 23 bp, Artificial Sequence
  Description of Artificial Sequence: Synthetic oligonucleotide
ccaccgccgccgccgccggcggg

SEQ ID NO: 3228 - DNA, 119 bp, Artificial Sequence
  Description of Artificial Sequence: Synthetic polynucleotide
attctaatacgactcactataggccaccgccgccgccgccggcgttttagagctagaaatagcaagttaaaataaggctagtccgttatcaacttgaaaaagtggcaccgagtcggtgc

SEQ ID NO: 3229 - DNA, 23 bp, Artificial Sequence
  Description of Artificial Sequence: Synthetic oligonucleotide
caccgccgccgccgccggcgggg

SEQ ID NO: 3230 - DNA, 119 bp, Artificial Sequence
  Description of Artificial Sequence: Synthetic polynucleotide
attctaatacgactcactataggcaccgccgccgccgccggcggttttagagctagaaatagcaagttaaaataaggctagtccgttatcaacttgaaaaagtggcaccgagtcggtgc

SEQ ID NO: 3231 - DNA, 23 bp, Artificial Sequence
  Description of Artificial Sequence: Synthetic oligonucleotide
cccgccggcggcggcggcggtgg

SEQ ID NO: 3232 - DNA, 119 bp, Artificial Sequence
  Description of Artificial Sequence: Synthetic polynucleotide
attctaatacgactcactataggcccgccggcggcggcggcgggttttagagctagaaatagcaagttaaaataaggctagtccgttatcaacttgaaaaagtggcaccgagtcggtgc

SEQ ID NO: 3233 - DNA, 23 bp, Artificial Sequence
  Description of Artificial Sequence: Synthetic oligonucleotide
atggtgcttcacgtccccgccgg

SEQ ID NO: 3234 - DNA, 119 bp, Artificial Sequence
  Description of Artificial Sequence: Synthetic polynucleotide
attctaatacgactcactataggatggtgcttcacgtccccgcgttttagagctagaaatagcaagttaaaataaggctagtccgttatcaacttgaaaaagtggcaccgagtcggtgc

SEQ ID NO: 3235 - DNA, 23 bp, Artificial Sequence
  Description of Artificial Sequence: Synthetic oligonucleotide
gtgcttcacgtccccgccggcgg

SEQ ID NO: 3236 - DNA, 119 bp, Artificial Sequence
  Description of Artificial Sequence: Synthetic polynucleotide
attctaatacgactcactatagggtgcttcacgtccccgccgggttttagagctagaaatagcaagttaaaataaggctagtccgttatcaacttgaaaaagtggcaccgagtcggtgc

SEQ ID NO: 3237 - DNA, 23 bp, Artificial Sequence
  Description of Artificial Sequence: Synthetic oligonucleotide
cttcacgtccccgccggcggcgg

SEQ ID NO: 3238 - DNA, 119 bp, Artificial Sequence
  Description of Artificial Sequence: Synthetic polynucleotide
attctaatacgactcactataggcttcacgtccccgccggcgggttttagagctagaaatagcaagttaaaataaggctagtccgttatcaacttgaaaaagtggcaccgagtcggtgc

SEQ ID NO: 3239 - DNA, 23 bp, Artificial Sequence
  Description of Artificial Sequence: Synthetic oligonucleotide
cacgtccccgccggcggcggcgg

SEQ ID NO: 3240 - DNA, 119 bp, Artificial Sequence
  Description of Artificial Sequence: Synthetic polynucleotide
attctaatacgactcactataggcacgtccccgccggcggcgggttttagagctagaaatagcaagttaaaataaggctagtccgttatcaacttgaaaaagtggcaccgagtcggtgc

SEQ ID NO: 3241 - DNA, 23 bp, Artificial Sequence
  Description of Artificial Sequence: Synthetic oligonucleotide
gtccccgccggcggcggcggcgg

SEQ ID NO: 3242 - DNA, 119 bp, Artificial Sequence
  Description of Artificial Sequence: Synthetic polynucleotide
attctaatacgactcactatagggtccccgccggcggcggcgggttttagagctagaaatagcaagttaaaataaggctagtccgttatcaacttgaaaaagtggcaccgagtcggtgc

SEQ ID NO: 3243 - DNA, 23 bp, Artificial Sequence
  Description of Artificial Sequence: Synthetic oligonucleotide
tcgcctgtccgtcggacttttgg

SEQ ID NO: 3244 - DNA, 119 bp, Artificial Sequence
  Description of Artificial Sequence: Synthetic polynucleotide
attctaatacgactcactataggtcgcctgtccgtcggactttgttttagagctagaaatagcaagttaaaataaggctagtccgttatcaacttgaaaaagtggcaccgagtcggtgc

SEQ ID NO: 3245 - DNA, 23 bp, Artificial Sequence
  Description of Artificial Sequence: Synthetic oligonucleotide
caccgggctcgcctgtccgtcgg

SEQ ID NO: 3246 - DNA, 119 bp, Artificial Sequence
  Description of Artificial Sequence: Synthetic polynucleotide
attctaatacgactcactataggcaccgggctcgcctgtccgtgttttagagctagaaatagcaagttaaaataaggctagtccgttatcaacttgaaaaagtggcaccgagtcggtgc

SEQ ID NO: 3247 - DNA, 23 bp, Artificial Sequence
  Description of Artificial Sequence: Synthetic oligonucleotide
cagccaaaagtccgacggacagg

SEQ ID NO: 3248 - DNA, 119 bp, Artificial Sequence
  Description of Artificial Sequence: Synthetic polynucleotide
attctaatacgactcactataggcagccaaaagtccgacggacgttttagagctagaaatagcaagttaaaataaggctagtccgttatcaacttgaaaaagtggcaccgagtcggtgc

SEQ ID NO: 3249 - DNA, 23 bp, Artificial Sequence
  Description of Artificial Sequence: Synthetic oligonucleotide
cggacaggcgagcccggtggagg

SEQ ID NO: 3250 - DNA, 119 bp, Artificial Sequence
  Description of Artificial Sequence: Synthetic polynucleotide
attctaatacgactcactataggcggacaggcgagcccggtgggttttagagctagaaatagcaagttaaaataaggctagtccgttatcaacttgaaaaagtggcaccgagtcggtgc

SEQ ID NO: 3251 - DNA, 23 bp, Artificial Sequence
  Description of Artificial Sequence: Synthetic oligonucleotide
cgacggacaggcgagcccggtgg

SEQ ID NO: 3252 - DNA, 119 bp, Artificial Sequence
  Description of Artificial Sequence: Synthetic polynucleotide
attctaatacgactcactataggcgacggacaggcgagcccgggttttagagctagaaatagcaagttaaaataaggctagtccgttatcaacttgaaaaagtggcaccgagtcggtgc

SEQ ID NO: 3253 - DNA, 23 bp, Artificial Sequence
  Description of Artificial Sequence: Synthetic oligonucleotide
gtccgacggacaggcgagcccgg

SEQ ID NO: 3254 - DNA, 119 bp, Artificial Sequence
  Description of Artificial Sequence: Synthetic polynucleotide
attctaatacgactcactatagggtccgacggacaggcgagccgttttagagctagaaatagcaagttaaaataaggctagtccgttatcaacttgaaaaagtggcaccgagtcggtgc

SEQ ID NO: 3255 - DNA, 23 bp, Artificial Sequence
  Description of Artificial Sequence: Synthetic oligonucleotide
ggacaggcgagcccggtggaggg

SEQ ID NO: 3256 - DNA, 119 bp, Artificial Sequence
  Description of Artificial Sequence: Synthetic polynucleotide
attctaatacgactcactataggggacaggcgagcccggtggagttttagagctagaaatagcaagttaaaataaggctagtccgttatcaacttgaaaaagtggcaccgagtcggtgc

SEQ ID NO: 3257 - DNA, 23 bp, Artificial Sequence
  Description of Artificial Sequence: Synthetic oligonucleotide
gccaccgccgccgccgccgccgg

SEQ ID NO: 3258 - DNA, 22 bp, Homo sapiens
gccgccgccggtggggacgtga

SEQ ID NO: 3259 - DNA, 22 bp, Artificial Sequence
  Description of Artificial Sequence: Synthetic oligonucleotide
gccgccgccgccggggacgtga

SEQ ID NO: 3260 - DNA, 23 bp, Artificial Sequence
  Description of Artificial Sequence: Synthetic oligonucleotide
ccaccgccgccgccgccgccggg

SEQ ID NO: 3261 - DNA, 119 bp, Artificial Sequence
  Description of Artificial Sequence: Synthetic polynucleotide
attctaatacgactcactataggccaccgccgccgccgccgccgttttagagctagaaatagcaagttaaaataaggctagtccgttatcaacttgaaaaagtggcaccgagtcggtgc

SEQ ID NO: 3262 - DNA, 23 bp, Artificial Sequence
  Description of Artificial Sequence: Synthetic oligonucleotide
caccgccgccgccgccgccgggg

SEQ ID NO: 3263 - DNA, 119 bp, Artificial Sequence
  Description of Artificial Sequence: Synthetic polynucleotide
attctaatacgactcactataggcaccgccgccgccgccgccggttttagagctagaaatagcaagttaaaataaggctagtccgttatcaacttgaaaaagtggcaccgagtcggtgc

SEQ ID NO: 3264 - DNA, 23 bp, Artificial Sequence
  Description of Artificial Sequence: Synthetic oligonucleotide
cccggcggcggcggcggcggtgg

SEQ ID NO: 3265 - DNA, 119 bp, Artificial Sequence
  Description of Artificial Sequence: Synthetic polynucleotide
attctaatacgactcactataggcccggcggcggcggcggcgggttttagagctagaaatagcaagttaaaataaggctagtccgttatcaacttgaaaaagtggcaccgagtcggtgc

SEQ ID NO: 3266 - DNA, 23 bp, Artificial Sequence
  Description of Artificial Sequence: Synthetic oligonucleotide
atggtgcttcacgtccccggcgg

SEQ ID NO: 3267 - DNA, 119 bp, Artificial Sequence
  Description of Artificial Sequence: Synthetic polynucleotide
attctaatacgactcactataggatggtgcttcacgtccccgggttttagagctagaaatagcaagttaaaataaggctagtccgttatcaacttgaaaaagtggcaccgagtcggtgc

SEQ ID NO: 3268 - DNA, 23 bp, Artificial Sequence
  Description of Artificial Sequence: Synthetic oligonucleotide
gtgcttcacgtccccggcggcgg

SEQ ID NO: 3269 - DNA, 119 bp, Artificial Sequence
  Description of Artificial Sequence: Synthetic polynucleotide
attctaatacgactcactatagggtgcttcacgtccccggcgggttttagagctagaaatagcaagttaaaataaggctagtccgttatcaacttgaaaaagtggcaccgagtcggtgc

SEQ ID NO: 3270 - DNA, 23 bp, Artificial Sequence
  Description of Artificial Sequence: Synthetic oligonucleotide
cttcacgtccccggcggcggcgg

SEQ ID NO: 3271 - DNA, 119 bp, Artificial Sequence
  Description of Artificial Sequence: Synthetic polynucleotide
attctaatacgactcactataggcttcacgtccccggcggcgggttttagagctagaaatagcaagttaaaataaggctagtccgttatcaacttgaaaaagtggcaccgagtcggtgc

SEQ ID NO: 3272 - DNA, 23 bp, Artificial Sequence
  Description of Artificial Sequence: Synthetic oligonucleotide
cacgtccccggcggcggcggcgg

SEQ ID NO: 3273 - DNA, 119 bp, Artificial Sequence
  Description of Artificial Sequence: Synthetic polynucleotide
attctaatacgactcactataggcacgtccccggcggcggcgggttttagagctagaaatagcaagttaaaataaggctagtccgttatcaacttgaaaaagtggcaccgagtcggtgc

SEQ ID NO: 3274 - DNA, 23 bp, Artificial Sequence
  Description of Artificial Sequence: Synthetic oligonucleotide
gtccccggcggcggcggcggcgg

SEQ ID NO: 3275 - DNA, 119 bp, Artificial Sequence
  Description of Artificial Sequence: Synthetic polynucleotide
attctaatacgactcactatagggtccccggcggcggcggcgggttttagagctagaaatagcaagttaaaataaggctagtccgttatcaacttgaaaaagtggcaccgagtcggtgc

SEQ ID NO: 3276 - DNA, 23 bp, Artificial Sequence
  Description of Artificial Sequence: Synthetic oligonucleotide
agcctgcggacagccccatcagg

SEQ ID NO: 3277 - DNA, 119 bp, Artificial Sequence
  Description of Artificial Sequence: Synthetic polynucleotide
attctaatacgactcactataggagcctgcggacagccccatcgttttagagctagaaatagcaagttaaaataaggctagtccgttatcaacttgaaaaagtggcaccgagtcggtgc

SEQ ID NO: 3278 - DNA, 21 bp, Homo sapiens
agggagcctggggacagcccc

SEQ ID NO: 3279 - DNA, 21 bp, Artificial Sequence
  Description of Artificial Sequence: Synthetic oligonucleotide
agggagcctgcggacagcccc

SEQ ID NO: 3280 - DNA, 23 bp, Artificial Sequence
  Description of Artificial Sequence: Synthetic oligonucleotide
ctgctgcagtagggagcctgcgg

SEQ ID NO: 3281 - DNA, 119 bp, Artificial Sequence
  Description of Artificial Sequence: Synthetic polynucleotide
attctaatacgactcactataggctgctgcagtagggagcctggttttagagctagaaatagcaagttaaaataaggctagtccgttatcaacttgaaaaagtggcaccgagtcggtgc

SEQ ID NO: 3282 - DNA, 23 bp, Artificial Sequence
  Description of Artificial Sequence: Synthetic oligonucleotide
gcctgcggacagccccatcaggg

SEQ ID NO: 3283 - DNA, 119 bp, Artificial Sequence
  Description of Artificial Sequence: Synthetic polynucleotide
attctaatacgactcactatagggcctgcggacagccccatcagttttagagctagaaatagcaagttaaaataaggctagtccgttatcaacttgaaaaagtggcaccgagtcggtgc

SEQ ID NO: 3284 - DNA, 23 bp, Artificial Sequence
  Description of Artificial Sequence: Synthetic oligonucleotide
gccctgatggggctgtccgcagg

SEQ ID NO: 3285 - DNA, 119 bp, Artificial Sequence
  Description of Artificial Sequence: Synthetic polynucleotide
attctaatacgactcactatagggccctgatggggctgtccgcgttttagagctagaaatagcaagttaaaataaggctagtccgttatcaacttgaaaaagtggcaccgagtcggtgc

SEQ ID NO: 3286 - DNA, 3825 bp, Artificial Sequence
  Description of Artificial Sequence: Synthetic polynucleotide
atgggcaaaaaccaaaatttccaagaatttatcggagtgagccccctgcagaaaaccctccggaacgagcttattccgactgagaccacaaagaaaaatataacccagctggacttgctgactgaagatgagatccgcgcccagaaccgggaaaagctcaaagagatgatggacgattattaccgcaatgttattgacagtacccttcacgtcgggatcgctgtggattggtcttatctgttcagctgcatgcggaaccatttgcgcgaaaattccaaggagtcaaaacgggaactggagcgcacacaggacagcattcggagtcagatacacaacaagtttgccgaacgcgcagatttcaaagacatgtttggcgcctctatcattaccaagctccttcctacttacatcaaacaaaatagcgagtattccgaacggtacgatgagtcaatggaaattctgaagttgtatggtaaattcaccacaagcctgaccgactactttgagactcgcaagaacatattcagtaaagaaaagatctctagcgctgtaggctatcggattgtggaggaaaatgccgagatctttctccagaaccagaatgcatacgatcgcatttgtaaaatagccggacttgacctgcatgggttggataacgaaatcaccgcttatgttgacggcaagacactgaaagaggtctgctccgatgaaggtttcgccaaggcaattacccaagagggcatcgatcggtacaatgaagccattggagctgtgaaccagtatatgaatctcctttgtcagaaaaacaaggccctgaaacccgggcaatttaagatgaaacgcttgcacaagcagatactgtgcaaaggcactacctcattcgatatcccgaagaaatttgagaatgacaagcaggtatacgatgcagtgaacagcttcacagaaattgttaccaaaaataacgacctcaagcggcttctgaatatcactcaaaacgccaatgattatgacatgaacaaaatttacgtcgtggctgatgcctatagtatgatatctcagtttatcagcaagaaatggaatttgattgaggaatgtctgctcgactactattccgataaccttccaggtaagggcaatgcaaaagagaacaaggtaaaaaaggccgtgaaagaagagacctaccgctcagttagccagctgaatgaagtcatcgagaagtattacgtggaaaaaacaggacaaagtgtatggaaggtggagtcttatattagctccttggctgaaatgataaaactggagctctgccatgaaatcgacaacgatgagaagcacaatcttattgaggacgatgagaaaatctcagaaattaaggagctgttggacatgtacatggatgttttccatataatcaaagtctttcgggtgaacgaagtactgaatttcgacgagaccttttatagcgaaatggatgagatttaccaggacatgcaggaaatcgtgcccctctataaccacgttcgcaattacgtcactcaaaagccgtataaacaggagaagtaccggctttatttccatacccctacactggccaacgggtggagtaaatctaaggaatacgataataacgcaattatattggtgcgcgaggacaaatattacctgggcatcctcaatgccaagaaaaagcccagcaaagaaattatggctggtaaggaggattgttccgaacacgcctatgcaaaaatgaactactatcttctgccgggcgccaataagatgttgccaaaagtatttctgtcaaagaaaggaatccaggactaccatcccagcagttatattgtggaggggtacaacgaaaagaaacacataaagggctctaaaaatttcgatatccggttttgccgcgacctcattgattatttcaaggagtgtatcaaaaagcatccggactggaacaaatttaatttcgaatttagcgctaccgagacttacgaagatatttccgttttctatcgggaggtcgaaaagcaaggttaccgcgtggagtggacctatataaactcagaggacatccagaaacttgaggaagatggccagctgtttttgttccaaatttacaataaggactttgccgtaggaagcacagggaaacctaacctgcacaccctctatcttaagaatctgttcagtgaggaaaacttgcgggatatcgtgctgaaactcaatggcgaggcagaaatttttttccgcaagtctagcgttcagaaacccgtcatacataagtgcggttccatccttgtgaaccggacttacgagattaccgaatcaggcacaacccgcgtacagagcatcccggagagtgaatatatggagctgtatcggtattttaattctgaaaaacaaattgagttgagcgacgaagccaagaaatacctggataaggtgcagtgtaacaaagctaagactgacatagttaaagattatcgctacaccatggacaagttctttatccacctcccaattacaatcaatttcaaagtcgataagggaaacaatgtgaacgccattgcacagcaatatatagccgggcggaaagaccttcatgtaatcggcattgatcgcggtgagcggaatctgatctacgtgtccgttattgacatgtatggccgcatattggaacagaagtcatttaacctggtcgagcaggtgagcagtcaaggaaccaaacggtactatgattacaaggaaaaactccagaatcgcgaggaagagcgggacaaggctcgccagtcttggaaaactatcgggaagattaaagaacttaaggagggctatctgagctccgtaatccacgaaattgcccaaatggtggttaaatacaacgcaataatcgccatggaggatttgaattatggtttcaagcggggccgctttaaagtcgaacggcaggtgtaccagaagttcgagaccatgctgatttcaaaactcaactatcttgctgacaagagccaagccgtagatgaacccggagggattctgcgcggctaccagatgacatatgtgccggacaatattaaaaacgttggtcggcagtgcggcataatcttttacgtccctgcagcctataccagtaagattgatcccactaccggattcatcaatgcttttaaacgcgacgtggtatctacaaacgatgccaaggagaatttcttgatgaaatttgacagcattcaatacgatatagaaaaggggctgttcaaattttccttcgactataagaactttgcaacccataaactcactcttgccaagaccaaatgggatgtgtacacaaatggcacccggattcagaacatgaaggttgagggtcactggctgtcaatggaagtcgagttgactaccaaaatgaaggaactgctcgacgatagccatattccgtatgaggaaggccagaatatccttgacgatctgcgcgagatgaaagacattacaaccatagtgaacggaatcttggaaattttctggctgactgtacaactccggaatagtcgcatcgataacccagactacgatcggattatatctcccgtgcttaataagaacggggagtttttcgacagcgatgaatataattcctacatcgacgctcagaaagccccgctgcctattgatgcagacgccaacggcgctttttgtatcgccttgaagggtatgtataccgcaaatcagattaaagagaactgggttgaaggcgagaagctgcccgccgattgcctcaaaatagaacacgcttcatggcttgccttcatgcaaggagagcgcggg

SEQ ID NO: 3287 - protein, 1275 aa, Artificial Sequence
  Description of Artificial Sequence: Synthetic polypeptide
MGKNQNFQEFIGVSPLQKTLRNELIPTETTKKNITQLDLLTEDEIRAQNREKLKEMMDDYYRNVIDSTLHVGIAVDWSYLFSCMRNHLRENSKESKRELERTQDSIRSQIHNKFAERADFKDMFGASIITKLLPTYIKQNSEYSERYDESMEILKLYGKFTTSLTDYFETRKNIFSKEKISSAVGYRIVEENAEIFLQNQNAYDRICKIAGLDLHGLDNEITAYVDGKTLKEVCSDEGFAKAITQEGIDRYNEAIGAVNQYMNLLCQKNKALKPGQFKMKRLHKQILCKGTTSFDIPKKFENDKQVYDAVNSFTEIVTKNNDLKRLLNITQNANDYDMNKIYVVADAYSMISQFISKKWNLIEECLLDYYSDNLPGKGNAKENKVKKAVKEETYRSVSQLNEVIEKYYVEKTGQSVWKVESYISSLAEMIKLELCHEIDNDEKHNLIEDDEKISEIKELLDMYMDVFHIIKVFRVNEVLNFDETFYSEMDEIYQDMQEIVPLYNHVRNYVTQKPYKQEKYRLYFHTPTLANGWSKSKEYDNNAIILVREDKYYLGILNAKKKPSKEIMAGKEDCSEHAYAKMNYYLLPGANKMLPKVFLSKKGIQDYHPSSYIVEGYNEKKHIKGSKNFDIRFCRDLIDYFKECIKKHPDWNKFNFEFSATETYEDISVFYREVEKQGYRVEWTYINSEDIQKLEEDGQLFLFQIYNKDFAVGSTGKPNLHTLYLKNLFSEENLRDIVLKLNGEAEIFFRKSSVQKPVIHKCGSILVNRTYEITESGTTRVQSIPESEYMELYRYFNSEKQIELSDEAKKYLDKVQCNKAKTDIVKDYRYTMDKFFIHLPITINFKVDKGNNVNAIAQQYIAGRKDLHVIGIDRGERNLIYVSVIDMYGRILEQKSFNLVEQVSSQGTKRYYDYKEKLQNREEERDKARQSWKTIGKIKELKEGYLSSVIHEIAQMVVKYNAIIAMEDLNYGFKRGRFKVERQVYQKFETMLISKLNYLADKSQAVDEPGGILRGYQMTYVPDNIKNVGRQCGIIFYVPAAYTSKIDPTTGFINAFKRDVVSTNDAKENFLMKFDSIQYDIEKGLFKFSFDYKNFATHKLTLAKTKWDVYTNGTRIQNMKVEGHWLSMEVELTTKMKELLDDSHIPYEEGQNILDDLREMKDITTIVNGILEIFWLTVQLRNSRIDNPDYDRIISPVLNKNGEFFDSDEYNSYIDAQKAPLPIDADANGAFCIALKGMYTANQIKENWVEGEKLPADCLKIEHASWLAFMQGERG

SEQ ID NO: 3288 - DNA, 24 bp, Artificial Sequence
  Description of Artificial Sequence: Synthetic oligonucleotide
ggagatgttgcttctcttaattcc

SEQ ID NO: 3289 - DNA, 24 bp, Artificial Sequence
  Description of Artificial Sequence: Synthetic oligonucleotide
tgcacagggtggaacaagatggat

SEQ ID NO: 3290 - DNA, 24 bp, Artificial Sequence
  Description of Artificial Sequence: Synthetic oligonucleotide
ggagatgtcttgatagcgacggga

SEQ ID NO: 3291 - DNA, 20 bp, Artificial Sequence
  Description of Artificial Sequence: Synthetic oligonucleotide
taatttctactcttgtagat

SEQ ID NO: 3292 - DNA, 20 bp, Artificial Sequence
  Description of Artificial Sequence: Synthetic oligonucleotide
cttccttgtaccaacacgta

SEQ ID NO: 3293 - DNA, 160 bp, Artificial Sequence
  Description of Artificial Sequence: Synthetic polynucleotide
tcccctttctttcccttctccttcttttttcttttctccttccttctttccttccttccttccttcttctttccttccttgtaccaacacgtatggctaatttgttttgttttttttgtgtgtgtggagacagggttttgccatgttgcccaggttggtc

SEQ ID NO: 3294 - DNA, 20 bp, Artificial Sequence
  Description of Artificial Sequence: Synthetic oligonucleotide
catacgtgttggtacaagga

SEQ ID NO: 3295 - DNA, 20 bp, Artificial Sequence
  Description of Artificial Sequence: Synthetic oligonucleotide
tagccatacgtgttggtaca

SEQ ID NO: 3296 - DNA, 40 bp, Homo sapiens
ctacaggtgtgtaccaacacgtatggctaatttgttttgt

SEQ ID NO: 3297 - DNA, 40 bp, Homo sapiens
cttccttccttccttcttctttccttccttccttccttct

SEQ ID NO: 3298 - DNA, 60 bp, Artificial Sequence
  Description of Artificial Sequence: Synthetic oligonucleotide
cttccttccttccttcttctttccttccttgtaccaacacgtatggctaatttgttttgt

SEQ ID NO: 3299 - DNA, 320 bp, Unknown
  Description of Unknown: target sequence
gttttaaaatggactatcatatgcttaccgtaacttgaaagtatttcgatttcttggctttatatatcttgtggaaaggacgaaacacctaatttctactcttgtagatggagatgttgcttctcttaattccttttttgttttagagctagaaatagcaagttaaaataaggctagtccgtttttagcgcgtgcgccaattctgcagacaaatggctctagaggtacccgttacataacttacggtaaatggcccgcctggctgaccgcccaacgacccccgcccattgacgtcaatagtaacgccaatagggactttc

SEQ ID NO: 3300 - DNA, 23 bp, Artificial Sequence
  Description of Artificial Sequence: Synthetic oligonucleotide
attctaatacgactcactatagg

What is claimed is:

1. A method of inducing cell death of a cancer cell in a tissue of a subject in need thereof, the method comprising:
    a) administering to the subject a chimeric polypeptide comprising a first domain comprising a Cas9 domain with endonuclease activity and a second domain comprising RecJ domain with exonuclease activity, and a guide nucleic acid comprising a sequence complementary to a target nucleic acid in the cancer cell, wherein the target nucleic acid is an oncogene; and
    b) cleaving the target nucleic acid, thereby inducing cell death of the cancer cell.

2. The method of claim 1, wherein the cancer cell comprises a lung cancer cell, a pancreatic cancer cell, a breast cancer cell, an ovarian cancer cell, a colon cancer cell, or a cervical cancer cellk.

3. The method of claim 1, wherein the target nucleic acid comprises a cancer-specific sequence.

4. The method of claim 3, wherein the cancer-specific sequence comprises a single nucleotide polymorphism specific to a cancer, a translocation, a chromosomal abnormality, or a sequence associated with cancer progression.

5. The method of claim 4, wherein the chromosomal abnormality is selected from the group consisting of: a translocation, a deletion, a duplication, an inversion, an insertion, a ring, copy number variations, an indel, and an isochromosome.

6. The method of claim 1, wherein the tissue comprises a healthy cell.

7. The method of claim 6, wherein after the administering, the healthy cell proliferates.

8. The method of claim 1, wherein the cleaving comprises cleaving at at least 2 cleavage sites in the cancer cell.

9. The method of claim 1, wherein the second domain comprises an enzyme having cleaved end resection activity.

10. The method of claim 1, wherein the Cas9 domain comprises a sequence having at least 90% identity the full length of to SEQ ID NO: 68.

* * * * *